United States Patent 10,093,940 (OPTIMAL MAIZE LOCI) - sequence listing, part 4

SEQ ID NO: 5085 - DNA, 1572 bp, Zea mays
  misc_feature (1)..(100): optimal_loci_235394_G1, chr6:159220514..159222085, Cluster 31
tagatccatccatgcctctgtccccttgggtggcaaactgccaaaacaatctttttttaatagtgtactatatatatatttgataagttaactaatatcgaataaatattattagataaatcatacaatatgtgtgcacagtagacttgttttgaagatattaatactcacaaataatctagttgggttaaaattgattgctcctaaaaatgaggtgcatacgtgcgactcttttctggacagagtgagttagccaatgcaaaaatggtcgtcccgacgcacactaatgaaattttcaaacgctttgagaaaaaaacgtccatacctgtagttttcattgatggcaatatatatccaatgtagtgagcatttgatgggatatgaatgaccagcagctggtctagttggtatggacggtgcgactacgatattccactaccatgggtgaggtccctttgctttagattgttatgctcatgtccctttcccagggcatttttgtgttgctttgttttatacgatctagaaacccccatacacatgaaaagctaaagtcatattgttataataatacacagtatttttttactatagtgtgtttttttggccatggcatctgttaattttcgtaatcatttcatattcttcaatatggctaaaacaatttttgaccatgtataaaaaaacaagaaaaaaatagtcaaatgagtaggggggataccgtaatatatgtgcatcgaccaattttataaacggccgtgtaatcattttggtgcttgaaggttgtaaccctatgctttcactcttgattaacgaaaggtgtctgctagttctcgtcaagtttttttttaaaaaaaaaaaaccggatgtttttatatatagcgctcaaatctctggtgataactttcaacgtggaaatgagtagccaaccttcaaattaactagttctcaccaagagacggcaaggttattagttttcactacggttaaatgcttagggttattaacatgtccagaaggcatgtcataatttatgtgctccttttcaatatccatcagctattacatccaacaaatattccggtgagaatagcttctgtgtcaatctgtcatctaaataaaaaaagatgatttgacacccatattatattatattcacgcgaaatgacggccggccaactgcatatctgcatggcttttgcccaaacaaggaatttgaaaggaaacacaacggctactactatgtagttaaagaaataaacagcagccactgacattcttggcagttattcccctcatcttttgattggctaagccgcgctcagctttggaatcgttagcttttttctggtagagtcgttagctagtaggcaatattctcacaccaccagttggatcccagcaacaaaggtaggcatgtagctggacgtactgaacgcgcacgcactgacctgaccatctataatttatgggcaacaattcttttgtttccagataagcctatacgtgctgctgcgcactgtgaatatgtatttaaccatcagatatatttgtgcgtacgttgcaaccaaa

SEQ ID NO: 5086 - DNA, 2339 bp, Zea mays
  misc_feature (1)..(100): optimal_loci_235416_G1, chr6:159241162..159243500, Cluster 31
  modified_base (353)..(353): a, c, g, or t
  misc_feature (353)..(452): n is a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
atgatttagactcaacggttgctaacccgtcgtcttacaaacccttcttactagcaaaagcttaggattttgtggtggtatcatcctgggtaccaaaaagtcaaaaggaagaccacaacatgaaagcacatctcgtcacacaaaaggaaagcaccaggggagccaaatgggagcatgagaccaatttcagaaaaactctaacaaggaggaaacaaagctaaccagcaaaagcgctccctcatggatacccttgacaacacccattgttgatggggaagtgtggtgaattggtgagtgatcaccgcaagaacaacatgtagataatcatcacaaggggtcttcttgtttaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatgcaatgtcaaaattgatttttggtgtaggaggctcatttgacaacgacaccattactggaagggagtgggggaccatcagatgcaaccatgagaaaaaccctaccatcagcctcagtaatagtgtctgatggtgtgataagttaaccaacaactagaggaggacatttgaacatgctggaggagtgttgatttttatttggaggttgtggcgtcctatgtgctgcacgccagcacatacttgtcttaacatgttgtcccacactaaacgcattgagaggcgccaatgacactgccaaggtgctcccagatttggatctaagcccactcaataaagacatgactatcctgcctagtagcgacaacattagtcaccggagttgcgatagggaccaagggagatacaacctgtgttggatctgatggttgtagaaggtggagtttcatgccaaaaccaacatcaatgatagggaccacgaacgagagtgggtgtaagagagtttagagttgttgaatggtgatgtgagagaagaaagaggagtgagcgaaaaagtggtcaacaacaatgagaaaccctagtcgggaaacccatgcattgaagatctcatctagtcaccattgcctatttttatagaccgcaagctatttctcatgcctaaacttgtgctttgaggttggcatataatcaaattattgcaaactaagtacacatttatgatatataataaattaggtctagttttgcacaagtaatcttgttgtgtggaaagtagaaagcataaagtcaaaatatacaccatatgaaagcattgaagcaaggaaatgtaagaaaaatgtttttgtgtattgaaaatgaacagataaataatactacattttatatctttgttagtgaaccctgactcgcatgaaaattcatgacacaaacttttcaaacttcgatcgttaacaaactgtttaccaccacatgcatgcagtgcatcatagaaaaacaagtagaacaaagcaacaaaataagtaacaaataggtgaacatgctcaattatggataacacaacacatcccattgtccatagcgaagttgaggagcacaaccgtgcctcctcaagacacatgataccgtatggttttgttgagcatcatgatttagactcaacgattgctaacccgtcatcttacgaacccttcttactagcaaaagcttaggattttgtggtggtatcatcttgggtagcaaaaagtcaaaaggaagaccacaacatgaaagcacatctcgtcacacaaaaggaaggcaccagggagccaaatgggagcatgagaccaatttcagaaaaactctaacgaggaaacaaagctaaccggcaaaagtgctccctcatggacaccctcaataacaccccattgttgatgggaaagcatggtgaattggtgagtgaccaccacaataacaacatgtagatgatcatcacaaggggccttcttgtttaggcatggatctaaaacaacaaacaaacctactagtcgcgtcaaataatggaggcattgaccataaatttgcatacaacacgagttcctcgatagaaagaggtcacgcctttcaagccaaatcgaggtgtagaagcacctccattgcaattgtcaattggatcttgggtttaggaagctcatttggcagggacaccatactggaagggggtgggggaccatcagatgcaaccatgagaaaaaccctaccatcagcctcaataatagtgtctgatggtgcaagaagttaaccaacaactagaggaggacatttgaacatgctggaggagagttgatttttatggggaggttgtggtgtctcatgtgctgcacgccaccacatacttgcctcaacatgtt

SEQ ID NO: 5087 - DNA, 2332 bp, Zea mays
  misc_feature (1)..(100): optimal_loci_237332_G1, chr7:732000..734331, Cluster 31
tgaacatggtgatcgtctcttttattttattttctgttcctttctttttgtaaacaaattatgtgagaaatgcagcatccatccatcgatctatccctctctggggttgatgaggagtacatgtcgtgcgaccgtccagctactacccagaggccacagggacagggacccctattgattagttggtcaccatagcagacgtccaatcccgattccaatccatcactctgaatgaacgaatgaaatgctcctgtatagtatagtagtattgtgtacatatacgtacatacgcattatatatatataatgcatgctactacatatatactaaaataatgtgaatgtcaacctcgctctggcggcggctaaagtctcgctcgaccaccaccgtaccaccaccaccatcatcaggaggaggagctagctctagctaggcgtgtagctcgctgtaccatgcatgctcatcgatttgatgcagcatttgcattggcctcctccagattttattttgctgcctatccgagaccgagtcacatctccatccggtgcatgattggacaataataatgcacgaaaaaccatcgcatccatccgagatatattatataatctaatgcgtgtggccgaccaaaatgtgtacgacttgtgcgtgtgtgaagagtctcacgttctactgattatattcttgtacaattatgtgcatgagattactgcgctccaattaaacggccgcccttaaacttaggttgaacgcggctagagaggtagagacgactgcgatcgagatctttccagcaagactgtgtcgtctactagtccttcatatataccaatgcaagaaaacaaacattgcatcatgtgttcaaacacgactgaaattaattactaatttcagtcggttatggtcagccgatagaaattatccagagactagttttcgacggttaaccataaccgacggaaattattagcctagtgcgcaagttaactgcttgtatctatcaacaatatctatatttatagacatccatttgtaacagatcatatatgttcatctacatcacatacattcataaacacacgtataaccgttcacaacatatatattcatccacatcacatatatagatagattcacaaacacacacactgcacacatatatattcacacaaaaaatacctattaactttattttagattcttcatgatcaccccacagtaacgcacggatatataggatatcttgtgtagatatttgaagcgcggtgactggaaataatacccctccggcctgcatagtgggacactgactgtacatagaatgaagatggcgagcgatcgagagtgatgcatgcgcctctcctgccgacacatgtagcgactacatgtgatggctcgctcgagtgcaaaagatctcggtccctcgcttcgacttttatggatcatccagaaagcaacaagggccgccgggctctggccgactaaacaagtggataccaagggatcacgtccccggcccctagcagagctagctctggatcggagagataattaaacagagacatgcatatatatatatatatactaattaactgcttgatatattttatagatatatgtcctacaattaattaatgcaacagaattgacatttgagctttatttatctctatatccagctgctaggagagttgccagacatatattaattggagggagtaacttgtatatataaatatcaaaatatatgtgatgttcatccatgatcaaatacaattaactaatggatcacatataatgaagaaacctagctatcgttttacaaatgccacctaatatatataatatatataagatggatcgaccggtaatatatgaaattgatgggaaaaaaggttgattgccagtcgaacatctagctagccattcatggtaaaaagttaagtttctggaagcagatggctagctatatatatgtcacactcacaccacacatagctttcatctgcacaaatccagcgaacgatatcctccacttgccgacatctatatatcgatagcccagcaacatatatataccggcagctggttggcaacatctatgatatgaatatatgatcctgctagaccatctatgatataatgattattgtcaagtatatgtaagtatatatatgattaatacttattctatataatattggatgttgttatatataccatgctaaagaatatgggattctttgattttattttcaatcgtcaagtaagattttttgaactatatcttcaattaaatggatatataaacatatatacttggataatgag

SEQ ID NO: 5088 - DNA, 1541 bp, Zea mays
  misc_feature (1)..(100): optimal_loci_25099_G1, chr1:152119972..152121512, Cluster 31
taaagtttagcacatgctaaaatttagagcatgctaaacttttgctaagtttcagcactcgagggctatttagataaagtgctaaactttaatacttggtgtacacgagaagcacgtgaccacactagtgtggcaaaaagtacagtgctaaagtttagcaaaaaaaaaaaaagaacaaacacatactaaaagtagcagcaacatcaattataatgcgcctgaacaggcaccatagggtgcgtccaacacggaacaacacctaagcatgcatttatttaggatagtatagtcattatgtatagtaattaatgcactttagtcaggtttaaacactcaaatcaaacggcttattttaataattaaattttaagtttagttaggtgaaaaaaaaacaaacggggtactagcccgtaggcaagcaggcatgcatacatatcgatgtgttctgcagtgtcgacgcccgtgcctctggccctctgcacgcgagcactactcgccaatccgctcagtggaggacatatgctgctcggatctcgatccatagacagtggagcgtggactgcattgcacgcagggaaaatactccaacatcgaggatgttagcagctaaacattatgaaccatgaattcaattaaagtttctaattcctcacaaaaaaagaaagagtttctaacaagccttgtcaattttatccagggtccattgaacaactagaccccgtttggttcctttggttccttttatccttaaaatctagatattatgaagaatctggattctagactttcagaatttggaagtctattttaagtctatttggtacatagttcttcctcaagtcctgcttcggaggagccacattgcacctctgcgggctaaaggccacgaaacgggctttggcccttatatatttgtaccattatataatccatgagtttaaacattgctaaaatctacccaaccaaattacatctacactgatgacctctcctacacccattcaataaatcgcactcatatataacacatctttaaaccaactgttcatattactagataatatctattttactcaatcaaatccaataatcaatattacttcctcttcctcccgtcgtcaacctctacctcctctccctccctgcaccaccgcgctgcccctctgagacccagtcggcccccttccctctgtagattcgctagctgcaggcctgcagcaacacgccaacgcccagctctgcttgcaggatgccatgccatgcctcgatgtctgtagcctgcctgacccagggagtgtactagtaccggcccgtgcgtcggtgcgtgcacgttctcacgcacaggtgacaagtcaggccggccaggactactgtcgcgtcaccggagttcgtgcttttacaatattgattttctccggtagcgacggccttgtagattgtactagtggtcgccagtggagtacaaaaaatgtcctcgagctttatgcattccagaacaaaatatatgttagaaataataattatgtattagagctaaccct

SEQ ID NO: 5089 - DNA, 1751 bp, Zea mays
  misc_feature (1)..(100): optimal_loci_253939_G1, chr7:107258070..107259820, Cluster 31
cttgctcttactgcttcaggattgttagatcgttttatgactcaacttcttatttttttaactttgcaaaacgatatcttttctgtttggagtgaattgtcatagtcttgcctaatgggcttagatccttggttaaattccatttgtgttcaagaagttcccttgaaactttgggcatgttcgctggtttatgtgcaaagaagtccatgttgtgcatgaggacacaagtgagtgcatattcctatggttggttgaatttggcctgatagttactactttggagagatcacatacaattaagttgatcttttcaatggaatttccctaggagatttattggatcctaactttttatgatgtatttctaggccatcttgctgtattttctaggagagctcagctacttcttatgcctatcttaggaattgggccatagccgcaagctgcacaacctcaatgtgaaaaatcataggactgctttgagtcacttctatttgggagtacacattgggtctaggatctaatgtactctattctataattagcttctatgtcaaatgtgatgggtagagttacttgcccaaggggtatcatcaccttcctaggtacaatgtcgttgaggggtttgcctattattgtgtgaagattcatgataacaagttccaccatttctaatgtgtgggtaaatataatatagagccccacatcaccatctatgagaacttcgataagttgaacttctactactattgggtccatgactaggagtgttaccttaggtaaaataaactagtccattgatactcccttgagaattgaattagaacctcaaaccatcttaagtaagttagagttacgagctttggagccatgatctcatggagggtaatcatggtatgcgacttggacattatgtgattactctttcaaagataaggttgatgacataattggcccgctaaaactctactctttctcgcttgtcctagtcttcatcttcatcttcatccatcttaccttttattttagccatgtcctagtatatggtagggtttaggccataatttttttagttgctcacatcaaacgactgaatgtttgctaaatgagtgatatgggcatcgctccaggagtaggtcatcaaaagatttagttttgctaatttttttgacttgttcatgactgtggccgagttgtcaaactccatcttcctacctgatagcttgcttgatccttctaataatttctacccttgtcatctcggtggttttgatcatagtacttatcatgtatgctctcttttgcctttgtctatttgttgatcatatctcagaaggtgtcaatatttttagctgatttttgaatgaagtatttatagagataattgtctttgagtccattgccaaagtaattaatgatgtccctatcaaatatgtctaccaatgcgcatcgattgttagcaaagcgcctatattagtcatgtatgctttcactgttcttctacttgtagttctaaaggtcttggtaattggttgtacaatcccatacaccccaaaacgtttccataatttgttgggctagtaccgaccaactatcaatgaagttcatttttagtttcttgagccaaaccagtggtgatgcctcaagtacaattgaaaagtagattgccttgacaccattgtttgctctagtgaggctaatgatagatgagtaacaatgtatccactaatttgtgtctttattgccatcat

SEQ ID NO: 5090 - DNA, 1445 bp, Zea mays
  misc_feature (1)..(100): optimal_loci_255452_G1, chr7:115285222..115286666, Cluster 31
ctgagatgattgcaaagatcagatttgactatttgagagacatgcaaattatttgaaataagtgtcatgcatcttttttctccttctaatggatggtcttttgtgtagtgctcactcactagtttagaatttaatgttagatgtgctttattgtttttttactgtgcttcttttcaaagtgaatggacctagaacattttttattatctaaaacatcttaaattatagattcttttgttttttagatacatagtttgttgctacatacttgaatagaagataaaactaaatatataataaaaattatatattaaaaaacaaaatgatctcaaaactagaacgaagaaaaagttgtctgaacgaagaaagcggaagcctcacgctgctgctcgtgctctccctccgaggcgtgtgggcatctcatggcccgtgggcatccacggcaagccaccgctgtccgctgcatctgggtcagttcatcggtgtgcgacggggcggcatcagctaacggtgaggcggcgtcggcaagcggtggctccaacaacacggcgcggcaagaagagcgccagcaactccacgtctactcccacttctccgtgagctccaaccgtcagttgcgccaccgtcgtctgcggcaccccagcggagattcccctcgcacctgcaggctgcagcaaccaccaccatcaattgatggtttctggcccagacacagcggcagcagtggagcaggtcactcaccgcaaggaaatcaagctaccaatatgtggtactctacttccttcttgttgaattaaccatagatcatgaatttcaaatcttgcacactagtctgtaaattttgtttaacgactgtggaggttcgctcaacatggcctatagattgctccctacactgtcagattttttcatgaagtatgaactattgacatgtggggatatatatagataggcactgaactatcttaatgttagtaaattgcagatttgtgtgtgataaaatgacctgtctaaatgtcagtaaattgcagatttgttctgtcgacatgtgaggtactgagctatctgaatgtcagccggtggtgttagacttttcatgaattgcagatttgttttgttctgaatatatagatagatagacaattgttagaatgatcctgctgcacacctgtcaatgatgttagttttttcatggagtattgctcaaagtttggagtcagcagtatttaacaacttaaattgtaaacaggatgacactttctaaccaaattctatgtgttagaggatttcttcaaggtcgatttgtaaatttttataaatcaaaatcaatttccggtgctgcccccacctacaggagaaaattttcatcttgtttgggctcaatcctttaatatataagcattttaatatatgcgtatgcactgatgattagggttagcaatttc

SEQ ID NO: 5091 - DNA, 3297 bp, Zea mays
  misc_feature (1)..(100): optimal_loci_257043_G1, chr7:123484031..123487327, Cluster 31
cactgcgggcgcttgtagccgctacatgcaggggacatggcctcttgcgggaggcactgcaaaagatctaaagtaacccttcaatggttgaacatttgttcccattatacgttgaggtaaacatttaatggctaaagtaaatcttgaatgattgaagtaaattatgaatggctgaatatttgttattttgtgtattgaagtaaatattgaatgattgaagcaaaccttgaaagacagaaacaaacctagaatggttgaagcaaacatggattgcaagaatgtttgttcctcctgtacgtagaaataaccatttaattgctgaagtaatccccaaatagctgaagtaaaccttgaatagttgaatggcttaatttggtgttgcgtgttgtggatggagggcatatcagtcctgttaattgtgtgcggctggcgaattagttccttgatccgatttagttctctagtgcagatcccgttaatcgcacacgactaatctggtaaattacgtgcgattggtgtggctagcgttggcacaattaattagtttgactgatttgtctggacctttaagtctaggtgatggaccatgaggtccatcatcctgggtgatgattagcacttatatatatccattcacagcatatatattcaccacatatatttacaaacacatatgtattcatccacataaaaccacattatatacattcacaaacatatctatccgtccatatcaagttcattaacacatatccatccacatcacacaaatcatccaataaatccatatcacataaaccatcaacatcaaaactatcatctgttgttcaattattgattagtttaaataacataagaagtactaatattcatgcattcaatcagtatgaactcagattcgtcggatggttagaattctcactgttatgtagagtgtaattgaacatttgattgataaatgagttagacgcctaggtgctgataattgtggaggatgagtctgaaaactaaatcttgaatgactaaatttcaccgtaattaagttagattgattattttttctatacttaagctaaatttgctaaattaaataagtttgatagaattgagccaacttggattttttttctagaagtaagctgaattggtctattttttattacaaatgagctacgttttttttaaaaaaagtaacgattaaatattatatcgtaactaggcttaacaaactaatatactaaaaacgcacaccgattactaaaccagtcacataataataaatattcactagcttaatacattcaaatatcgtgggcgaccgatgaaaattgtaatcactctgctttgtttggatggaggtaggaacgtagaaaagacgggatagacatgtggtggacaatacagagaaccggacggagatggtgaccgcgctgagacgctggcgacgcgtggaatggacgtggcggcgatgtttagacgcaggcgttggagcgatcgagggtgagagggatcagggaaagccatagataaagagcacacgttggtcgtctccgacgaaaattgtctagttttcgttggcgcgctggatgggtaccgataaaaattagtcgaatttctataataaatttaactaaaagtctatgaggaaaactatttcggctttccctgttttaatttgcaagtcgggctcgggcatgagccacttacggtagcctgtagaggcagcaggccagcagcagcagcagcagattgggaggcaggcagaggcagcggcaagtggtgcggggcagccggcaggaggaggtggcgagcggggccgggacaggcagggtctcgtcctcggcgggcaatgcaaggagacgacgcaacttcgcccatcagcctgcccctgcctgcctcccgggggaggacggggacgtgtgcatgctcgccggccccagctcggcctcgtgagtgaactgaaccgtccagactgatggtttccggtcggtacggtgtcattcgatgtcgtgccgtttcctggggcactgattagtggtttttgctccgtgcgaacaagttggcatgatacatgtttggtcagggtcgggtcgggtgtacaaaacgagagacatatgcatgcatggtgcgacgactccttgctacagtaaattctctctccaccgttgacggtgtggtccatggaccagcactaaaaacgctcacatgtacagacgatacacgctgataatttgaatggctacaggacactaggctggtaagattgacaagaagatcagcttgttaggtgtcgtgtttttttttttttgtatcactactagcatgtaatgtagtaatacgtattggctagtactgaataagaagtttcgcggcggggggtggtgagtttgcaagcaaccggtctagattctgactcggggagtgatgctccgccagaaaatgttctgaccttcaacatggatggtccgccagaaaattaactagatttgagacgaactgattcccaagtttgacctcacgaggttagacaccaaccggtaactaatctggctggcgtcggtcttgtctgcaaaaaaaaaggtcagcagcacgcgaggcgcgcgtgatgtttgacaatagagaaaggagatgaccctctcctcacctgttatctgcctgccctgatgactgtacttatgagcgtagatgaagtggcatgaaattaacgatcgacacgactgtaaggacatgtataaccccatttctcaaaaaaaagaaaacaacatcgaagagcaaaaggccacgccgtcaccgtcaaagcgcggagcatccaccgtgggacgacggaggctttgtgctgcatcattgcagaatccttaacgatctccaaaggcgaaagcaaaagggggtccgtcacgagaccatggcgagagattcatgccggggccggccgatcgagcgcgtaggtactcgcccgccgacgccgacgccgacgccgaccgcatccgcatgtcacggtgtgggcagaggcagccaggcacaataaccactctctggtctggtgtctggtgttcggcagcgaggtccgtccgtcccgggtcacctgcggcggggctccgacgcgacggctgcctccctctggtttggccaccggtcagcccgaggcgcgcggggcattgatggcggcgcgtgcgcaagtctcaagaggcgcaccgcatccggggagaaaagattttgccgccgggtcacgtcagagctcggatccatcgcacgggcacggcacggcacgcggcggggctgtggaataaatggctccgc

SEQ ID NO: 5092 - DNA, 1555 bp, Zea mays
  misc_feature (1)..(100): optimal_loci_25738_G1, chr1:156210440..156211994, Cluster 31
caagagcctttcctgcagtcactactacacaacgtacttgtggactatcagcatcagctcgctcgtggttataaccgaccgtgatagaaaccgccggtgataactttaatatatcatcacctgttggttggctctacaattaacggttctaacaataaactgtaatagtaagccttcgttacagatttgtaagctaatacttatgaaaataatgagatgaaccgggataaaagattatttcagtagcatgcactagcagtgtggtcggtcagtttgtcgcttcctttgaccagaccctgcaactgctactagccaattcacccgccaaaacaagttctccgatcgacgcgctcaaccaactgccatgtaaattaacaacttcagtacctgtactgagcaatctagtactgattgacaacaaatcatgcaattcagtgttaacttgaaccctaatttggacacattgcgcgcatctggtggtgcgtatccagaactcgtgtgtcatgttgctaactatccaattaagcatgatccatcagtcggtctacatgcataccggccagctgcaagcacatggctgcgcgcgtttcgtcgtgcctctgctgaactcacatgcatgcatgcctgccaacgcgcatgatatatgggttaaagagacaaatatgcggtgcaggtcatgtacatgcttttattatatttattagcgtattaattaggtgcaagttaacgtgtaaactatattttttttaaaatcgcgtctttttcgttcgttaagttttcaacatttagtgtatatatgtggtacgttcatatacgtactcatgtgcaaaagttaagctacaaaccacaggtagaccaatttcatatgtgtgtagtagctatataagacaaaaaataggtttttatcttgtagcgcatagaaaccttaaatttgcaatttgtgtatgttttttttttaatttggctttgcttcttaacttttactatacgtgagtacacatgcatatggatgctctgtgaatataatatcttttgaataatccaagtacgattttgaaatgatttgtgtatgtttatttgcacctaatatatggtcgtctacaccacgtatttccctgggttcggagagactcatcacaagtgccacacagcaaaaggcagatcaactctctcgatcccataaagataaattaaaaaaaatgcacgcttgttcgttagaattacctttcggctgcatgtcggcacgtacacccaccgatccaaccaaatgcgcatgcgcttcattaaccgtcgcagctgacaccatgatgaggccccacgtcgcgctgagtgacacgtgtcagagagccagagagtagtcacttgaccggccgccgcgcggtcaaatgatgacgctgcccggatccctatgcgtggccgccgttggttcccttctcgttagactcagagtggagcggcaaatggttttttgaactaataataatctgtcagggtcaggctcgtctgacactccgtcacatggcagacacaaacaatgaactaaatatctagcagc

SEQ ID NO: 5093 - DNA, 1809 bp, Zea mays
  misc_feature (1)..(100): optimal_loci_262649_G1, chr7:155053755..155055563, Cluster 31
acatgcctcaacggaaatggttacactaatgcatgcatgatgcatgttgcaggtcataagatcacaagacctagtcaatctggggtagtgggcccaataacaggtaggaaccacatgtggtatacacgtataatacccttagggtggtagttatacccagtagtcgataccatgttcaccttgagaagagataattatgatggggctaacaataaatgtgaggcgaacgttgtaggcatgctctcgtcctaacacatgcaaaggggctaggcatacccaaagccactgcacaaagcattcaagtgatacgagcataccttagcatttatgtccatatacattcaagtgattgcctaccgtgggattgagagaatctttttgcgtgacatctttttttttctgtatccatttttttcttgatatttgcagtgaaagagatgttcatatatacgctagctgctttgtcgtcgaaatgtcagttcgtcagtcatttgccaaactttatcttcatgaacgacgttagtgcccgttcgggcgcgcatgcactcgtacatgcaagtgcagcttccacgcgcgcgcgggcaacctgtgacttgactcatcgtggagaaaaccaaacgagtcatgcattgcatggtggacagagcacgctcgacgagacggctcgtcgtggatctaaaaagtcaccaaaccacgacgacgacttgacgactgaatattaatttccaatgttcttcaacgcatgtggaaaaatgcctgtgtgctgcataccatcaccagcaacgacgaccgcatttcttagtccaagtgagcgaggtcgaggaggaactacagtgtacgtctatcgtacatggaagattatgccctatcgctctcgctctgacaaaatgaaatcttggtcgttggtggcaacaggcggcaacttctggagacgaatcagctgaagcctgaaggggactcatgtggagtataatttggcgtgccgtgatgctgcattgcattgagccatgcatatgcctggtgctgctggtgggatgaattccacccgacagatgttgcgaaccaaatcctaccattatataatgtgtggtccagcagcgaaaacatcaagatgtgatatccagtggacgacttgcaggggatgtatgtatatgaattgactgatagatcagctaagatttaagtacatctaccatccgactatatatattattaacgttgctctcacaaattgcgcaggcaggtgtgtggcaactaacgtgcatgtatacctgaatgaatgcacgcgcgaacgggcaattgcaattagcatggggtcgaccaccaacataaaatttggtttgaataaaaaacgtgcaaagcacgttcttggaaaatttgtttagcaaatagcaacaaatatgacatttcgataaagcaatactacaaggacattaaattataaattaatttttattcagttctaagttgaactcgcccaatttcaactaatttgtgttagtaattttatgggtttggcccatataaatatttcaataagtcctattgaataagttatgtgttatggcggttaagtacaatatgataagttaataggatggtaacataggttatctagctggaccatatttgtctatctggatttgttggtaaagtgatgaaggtgtgccacacgcccgcacgcgtgacctccgacccaaggcgtgtcgtggtacgacgctcatcgctatttggttcgccactacttgcctctgctttagttgttagacaagtgccatcattctagttcctgcgtgcacgactactaga

SEQ ID NO: 5094 - DNA, 1507 bp, Zea mays
  misc_feature (1)..(100): optimal_loci_262781_G1, chr7:155756569..155758075, Cluster 31
cacaactgctcggtactgatttgatgacgttatcgtattgtttctggtggatttatgaggaactgcattgcacatatctacttttatcgattgtgatctgtgacatcgagcaacacaccgcatggttccaccgatgtcttaagtataggtctctctattggattttttttatgttactgttttatatgttcaataagacattgccgttggtaacgatcaatatgttcatcttgtttaccactgtagcaattaaatgtagtttacagcgtatgtattatcacgaatttattgttattattattctagattaagttaggcctgaaaaaagacgtctaaatttctagcaacgatttagaacggtgggagtatatgtctaaatttctaacaataatttgaaaggggcagagtacataacaccgatctgattcaattttgggccacatatattacctttaggaagcagagaagagattatttgatagtgtagaacctttttgaccagtaaaaaatgatcaattactgagtattgacgttgtgcatggggggcaaaaccgcgaaatggtgcctttggggggctttggccatctcattgttgaattctccgcttggagaaatgcaaaaccaatcaaaactgcatgattaccatgggcacccaccgtgcttattttgacttgtttcctacgttcaagggcccacacgtgggcatggctccttgcacctttaatccgtgcttggttccatgcatgcatgcatatgcactgtccttgtccagatcgatcgtcttgctgaaactttatttataacagcaaactacgccaacgtacgatttgctccgatccatggaacaccatcattctgaaaatctgaatgaccacagctagtacatgcatgaagaatgcgcgcatgctccatttcagtcatgacctgtttgataattatttagatgtagctctcggtctgtgtgctgaacgtatataaggttaatttgcccatgcatattagataataagggtcagacaagttctcttgttacggcactagctagtagtgataccaaattattcaattgcttagaacatactcgtgcaccggccgtactgtgaagtgcggggatatgcacacgccacgcaagggcatctttatttgttaaatacagtaactacagtgatgagtgattatcctagactccaagctggacgacttcagcgtcatctcttggattctgcacagctaaacaatataacaatacaggctatagctagctaacaccgtacggcgtacgtgcctgtgaggattagaagagagcacgcttgcagtcaaacaaaaagcgattagaacagcagcatgcatggtggaatgctgcatgcagatgggcaacactactaacacatgaagcagttagcactttctccagtaaattgtcgtctctctgacggtttcagcactgaccaaccctgttcaagcacacggtgagagtatggaagtttcccatttcgaaatgccaagg

SEQ ID NO: 5095 - DNA, 2534 bp, Zea mays
  misc_feature (1)..(100): optimal_loci_264925_G1, chr7:166756199..166758732, Cluster 31
gagagactggagaccagtcttcacactagaggtgccaaagtgtgtcgcactattttatgcaaccgtatcgacaaacaaaactggcattatattggtgcatgtcgtggaacgccaaatctctctctcgatctcgcgttagtttacaattgttcagccaaccgttgcactagcacgtacgcccatgtacatatatatgcaacgtacgtagcgtcggccaggatcggttgcaatctagcatagtgacacttttcgaacaacaaggaagaaacgacaggcactcgatcgtgaacacttattatatattaattagtttgggagaaatttctatagatatacgctttatataaaaccgcccaagtcttgtcctgttcatgcagcaggcgggtagtatatatatcctgtcaaaagatgcagaagctagctaactaggcatgcatatgattcaaactgcatgtgtgtgccggatcaaccaaatcagtctactactgttttaaagctatagctctacctaatactacagtatataaacaaagagttcgatgcatacacacaaatccaaacctaacctgctacctttttttattatatatattagcttgcaagagacaaactctccactttgtatgtatgatacacgccactacttaagcactagctaatagccatgtagcattgcagtttgcatgcatgcttgtccaagctacaatgaaaaggtatcagtgatccatgtgctcaacagacagtgaaccgctgagttttcggttttcggcacttaagcttgtacgtacaatctacaagcttcattcatccctttttaatttgctttggagagaggagatcgagagggagggagatcgacagtgattgcaagagagtagggacaagaggcagaggaaaagaaaaggcgcggcgggcgagcccacgcacgcatgccaaccaaaatgtgaacaaaaccaccgtacgtacgtgtctttccatatcatccaatgataaaatccagtcaccttccattacacaaaaccactgtatacttcttgggcatgcaaggcaagctgcctctagctttatttatttctgatgcaatgcaacgacggccttagcttgcttgctttctgcactcccaaacaacactactctctatgctattgttgcatgcatcgcatctacctagatcgatgaaaaggccatcgatcgagcttgcttgtaattatttgagttgattgtaactgccagcggcagctgtcagctagctttgcacaggtagcagttccacttccgaagaaaacaagctgtgtacagggacctcttcgagaggttcggtgccgacgtggcaaatcgtcgccaagacataaacaaatgcagatccggtagaagctagcatgcatgtcgcgtacgaacgtagtattcactacgtgcatgcacttacggcaaagcaattaaagtgggcgaaaatgtttatggccaacacgtatgattgacctggatcggtgactctgcctgcgcccgtgcgtggtctcctttccacccttgtcgttgtcgcgtccggacacggtgggctcatttggtgggcgcactacactactcgctgatgaaccacttcgaaactgaccgccatgtgtgtgtgcgcgtgcaaccgttgcttcgagttttcagtttttttgtactagtatatatgtgccaacaactacctgtccatttcagcctatatttaacttgcattatttgtcaccatcaaattactttagcagttttggttcctcgttttttttcctataaaaactcgtttatggatacttatattagcaaaaacaaaatctagaatcatactgtatctgtttgggccgcggcaccttgtgctttttccccccttttggcgcatgcagcgtatatataggactgaacgtacgtacgtacaggcagcatcgtctgtcgaagaattgccattggatggttcaaagaagtgtgtgtgcagtgcagggatgatgtctcagaaattaaagatcgcgagatgtagggtctccaatataaatttatgtcaacagcaacctataggtcacgactcacgggtctactagtcattggcgcggctcattgcattgcatatgtatatatccttctctcgtcttatcgtcacacacgctttccttctccgttagccaaggtgactgactgttaacatctcaaataaaccaaaaaaaagtgacggttcgtaacttgtcttcgcatgctaatatccgctgagaacgaccattattgcaaacaggagtgtggcggcatctagcaccaggaaagggcccggccggccaggcacaagtttgtgggcagggcccgtggttttgcaaccggcttttgctgccatcgatccttgcacgtacctccacctccacccacatctccaaattgatcacaggtctatgaactagtatatattcgaagcaaaaaaaaaaaggcacgacctacttacaatacaacatggtttgtctcatgctcgtgtcaagacctagtccatcaatgtatgaggtccattgtgccta

SEQ ID NO: 5096 - DNA, 1791 bp, Zea mays
  misc_feature (1)..(100): optimal_loci_266142_G1, chr7:173057422..173059212, Cluster 31
aggaaattacgcttctaggaagattcaacctatatggaagtcagttaagcaagtttcagtctagaccaaattggaatcgtatttaacatggattcacaaggcactttgaccccctacccatagagcaagtccactctagcttatccatctaagcagccatggttggttgatggcatcctatagatcaaaaaataaaccattctactattcataaagttagaacatattattcataaagtctaggatccaaaaaattgaaggaaactattaacacaacaaataaggcacctaccaattctagattaaatgaccacctaacaatgatattatcgaatcaagccacaaaacataagtgatacttatcatataattgttgactcgtgctacaaactagtagcaatatatctgtgtcaggtcaagccacaaatagacaatggtactttagtatcactaccaggttttatgttgacccaaaaatgtcctctggtattagatccacctaaaaaacaattggttgatttctacaaaactaactagaattggatactagaatagtcatatgttgtagagtgagggttgtactaaaagctcttatgtaatacagactaacacacaattgacactcttatcgtctccaatttatacaaaaaacaaataaacacatggaatataaatcaattctattataaatgatgaagttaagcttggaatacatttagaaatgcatagatatataaatctactcaaaataaactggatgaaaaccaacatatcgtatattttcatgaagattataatacacgattgttcatagaaagggacatgcatatttatatataatgttatttaaagtaacctcgaggaagttttctaatccataagaacatacttgtatcttatgtatccaagtaatccaacacacaatcaatgttacccatggtagaagagaaaacacataacacacaaaatgatgatccaatatgaaacacatgcacaattgacactcttgtgggatcaaacttagacacaaaaggttaagtcaaatttatttagatctcaataaatatgtatgttaatgggtcattttgaccaactagtttcaagagttgcaagtttctattgattggttgcttgtattgcttaatgggcatggctcacgggacgtactaagccatctcagccagactcattggatgcatatgcttacttgattaatatgttataagtgtgtgatcagtacatatcaagtgataattcatgcattttaaaagtttaagccataaaggataaaacatgaacttatacttgtacataataaatcagtgtcatgaccttgtattatttttatctcatgcaacatatctttgcacaagcaatcaaacatcttttcttggccaagctaagagatacatgcaaccaaaagtggtactattatatgcattcagtgtgctccatgggacttgactctcttagatatgagccaagcttgactcatgcatgaaccaaacatcccctagaagccccaaaagatgccctaaggagcacccttggttactagtatggcaatgtgttctcttcatttatgaataattcttggatgcggtgtttcaagtttggttgaatatgaaatatgttttatttttcatatcattagctcaaatatctagttcattaggtgttatggatgcaaacatgcttagctaataaggcacccaacaatagctaaaggacggagtctaaaaacatataccagttgaggttgactctagcgaatgaagcgagacttgcgat

SEQ ID NO: 5097 - DNA, 1442 bp, Zea mays
  misc_feature (1)..(100): optimal_loci_266608_G1, chr7:175167816..175169257, Cluster 31
aattaaagaactaacctcaacagtaaaaaaatagacagaccatgataaattaggtagcaaatcaaacagatccatactcctctgtgacaaaaacaattagcgtcctcatttttagtaagagttaactaaatataaaaggtactatagtacatgattagtatattattagataatttttgtttacttttacaatagacttatttaaagatataaatgttgaggatatagatgttgaaattttgaccgacacagatactatgcgacaactatttagggacgcgggagtactacgttagcatgcatagatttgtgtcgatctgacgacgcatggattgtgagtttgggaactggccggcttttttaaaaatatataaaatctttcgtgaggagatgagttcagtttgcttgtgttctgaatgaacgatcattcagacgcgcgcgaacgttcgagagccgcttttgtataatgaagcttttatagtgcagcgttgacctaagacctggccaatggatttgcctggtctctctctctctctgttgtagttgcgacctactaacaatcatacattaattcatagctagtgcccataaacaacggttagacagccgccgcgcgtaccaattgatttggtcgcattctgagaaatctaatccggcaattcaaattcacccacctctctcacccactgctgcttgctgaagaagcatgcatgtgagagacttgatgcatgctagcatatgttactaatcgatggatctatcgtcatattgactgttcaaatttgtagttctagattttattcgcatatcatatgctgtttggatgctgattatgagcctaattatgaactaagcatatgacttactcgtacgtgagacgaatatattaaaactaaataatctgtaatttgtccatagcatatgtgatgatcatatattacataagcttaacgcgtattcgtcttctgaattagccatggctaatgtagttagttttatagttagttaatattcagttctcttaattgatatatttgatgactaaattttagtatgcagttcatccatgtacttctcttccacgcgaaacaacaccatcacattgaagcaatcaagcatacagtgttctgcatcccccaagaagcatcctgcataaaatcgcatgcatgcagtactctttttaattagtttgactgaatgaacagagagcagcagtttcgctgatggagaccgggggacgattccaattttgtgcgcgcgcgcggccgatgaattttctacttcagtactcaactcaggaccctcatcttctgctacctccaaatgtgtattgtcgttgactagtgcctagtggtgactctgatgagaccgtacgtccccctcttgggtctccaccgggagaccatggaaaagcccaaggccgaacaaggagggagggagac

SEQ ID NO: 5098 - DNA, 1853 bp, Zea mays
  misc_feature (1)..(100): optimal_loci_266867_G1, chr8:77903..79755, Cluster 31
atatgctagacagcttgaggatgaggtaatatattgaacgatcggcgacaagacagggttctcatatttgctttgttcttctttacaaattttctcaatagcaatagacgggtacttttcaactaaaaatgtcctgtttgagaaaaaaatattttatcttcagtgccctattttaaaatttagaatgcaactcataaaaaacagcttcaactgtacctattttacagtttaacggttgtagcttaatttatttcaagtccctaaatactttaaataatatagtattgtttttagggcattatttcgaggtattttattggagattctcttaagagaaaaatattgtattcaagaaaattaaaatgtttcaacttcatgagaaaaatatgttagttcaaaggtaaattatggataaggatagactgagtcatcaccttgttacagcaggaagattgaattttttatgtcggccaaccaggtaacgaaacctatggttctgccaagactttccaaaagcttgcctataaagatcagtaagttcaggacaaatactgatggccaccgttatttctggccgtcgagaatgactgatagacggtgtagtgtataattttaactaaaattccaaattagcgaatgagatgacgtgggccaagctttctatataaactttggatcgcccaacctgggtcaagcggagcgctgatgggctgaatttggcccgctgttccaccttcaaaccgagattcgatgtcattttacctgtctgtcatccgaatgattttgcattgttgagttttcgttcaagtattgcaccaataggaaagagacgcatcacaaaataaataagatagaagacaacaataaattaaattacataaaatttgcaactcaaaataacaacaagcaacctaaataaaagagcactatatataaatattaacaaggaaaattaattagattttgttcaacactaatcccttacatgttgtaatatactagtaattagcgcgcacccagctcgcgtagaaaacattttgataatataaatgataacagaaatataactaaactaccaagattcgctaagagattgatgttgcatagatgaccatgggcgtcatcgagctattagagaagcagatagaattgttaattacacagattatattaatgcattaaacttaattatgtttagagaatctataaagtaaaaataaacaacaatgttgcttttggtaaataagcagaaagatggaaattaaaacctttaccatattgataagaaaactatagctaaggaatcaagatgaaggagactgatgtaaaatagtttaaatgcatatttaatgtgtcacagattttattacgtagattttattaatgcattgaacttaactatgtctataggtgcatgaacctgtatacctataaagtaaaaatggacagcaatattggttttggtaattaggcagaaagatgaaaattaaaacatttaccatatttggccattccatctcacatattttctgtaggtgcagtaaatgggttctataatgcttcagcgaataagtagaaagatcgaacagaatgactgaaaaatgctcgcacatagttcagctcaaattaacatgaagattgatacagcaaataagcagaaagatgtaatttaaaatatgtagcacatttgtccttaccatttcagtaatttaactggaaaatggaataacgacctcatattagtgagcatgaacttaaaaaattgtgtatgtgtagatgcataacaggttaggagattatatatgttgccgaatgtaaggcatgtaaggcatgtttggtttgcttcttaattt

SEQ ID NO: 5099 - DNA, 1465 bp, Zea mays
  misc_feature (1)..(100): optimal_loci_268403_G1, chr8:8399227..8400691, Cluster 31
attcaagaatccttgcttgcacacacaataacagccaacactcaatacatgcttgtcatgagctcgcacggcagcttaagacccgtaacctcccattctgttacattccttgtgctgctagaacactgaagaccatcattgaagcaggactggaaaatgtgaaaccaattttgtccaagatccgcgagtttattcttcacatccattcaaaccaggagatgatggaggattttaagcactggactgaagtttatcaagaaggttcatggaaactcccctttgaccattcagcaaattggaacagtgattataatatgcttgatgtggtaaagaaggtaatgtatagtccattcatgtatatttggggtttgctactgtactcccaaataactgtgtttaattaattcgattgtatggtcattatcatctattacgtgaaatatatatttatatgattttttattttataaaataggatacataaggaaattttatctctaaaaaacctttcttttaggtgcatgcatgatttgttggatgtaatatctttttattttagaactttggatgacatggtatattttaattttgcatggttaggctgtgacgtgacaattttttttaaagaagtgactgatctttctgtacactaacatgattaacacggcatgtatatatgttttggccaccactttgtacgttagcatatataacatgtacattttgtatgttaatgatgatttgtgtgtttttgtgtaaatatttaccacgttaaaacaaaaaatatattaacataacattgtatacatgatgaaccgtttgaaaaaatcttttaaaatcctatcataattggtatgcaactttgaccttgtagcatgatagactcatatgtgtgtgaacagagactgtagcctccaactcatgatcatgatgtgcgtcaacactatggtgcacttgacgcatgcacaccgatcaattttaggaaggaattgatgtgcgtgatgtgcatcacgccaagtagattaaggaggtgggcgtgattacctgatttttgttttctgttttttctaactattttaattattaattgttttgtgttctaaaaatcaaggacctagatttatttgagttcttaccttctcaaaagtaatgggagtaccatagcaaacccctgtacatttttaccatgctgatgctcttcagttctgtatactctttttctttatatattttaggctcctaacgcaatagagaacaccatcaagaaggttgaagagatcttcgtaccaagggattgggttctgactactgcagagaagtcagtgatcgatgtgttgcactcataccttgaaccattcttcaaaactactacaaacctttgtaattgcaagctaccaactcttgggctcgtcttcttcttcatggaccatgtcttcgagttgatcaatctgtgtcatggcagcag

SEQ ID NO: 5100 - DNA, 1491 bp, Zea mays
  misc_feature (1)..(100): optimal_loci_2792_G1, chr1:14400844..14402334, Cluster 31
ctatatatgtggctcaactatcttgtacactaaatcgcctattcatctcacatgaaataaattagtctggcattcaattatcaaagccaaatcaggtctttcactccagagctcctgcttgactagttgccgctcttccgtgatgtttgccacctcttccacccccagactgcagtggtatactttcccccaatctatttttagtgctaaaattggggctttctcaaattgaattatttgcttctccatatgcgcatcttactgtaatacgcggtggtggcctatgaccgccaggatgtgtctacaacgcagtacctatggctataagttgcagcttcctccacaactggtaggccaatctcccccatgcaggcgcgcacaggagagggaaggctctcacgcgtgagaaactgagaatcgcctgcgggccgcgaatggcgagcgagcacggcttgagaatctgacgatggaggaagcttggatagtggaagggtatttttggagatcaatttgtagatgctggtggaagcgttttctttcctatactggccttctcgaaacctgtaggagttgctctaacaggtaagcatcatcagcccctccttgtccctcagtttgtaatacagcaatttcagatatggacatagaaaaactctaggtccaccactgatagtaatcctctaccatcaaaatatattttatttgttttcgaaaataaataagacaatgttaagagtacatgtagaaccttctaaacatctgaacttcagattcaacaccaaatcaacatgatgagtttcaacatgtgagttaaatgacaaagtgggttgctttagaaagcaacacaagttacctagttagggcttaagcagacaattattttttgggtagtgatttacaaaataatttattttccgattgcaactatgtgttacactcaattttaaaaaatatgttttataatcagaccacacatcgaagtacaggtgtgtattatcgaggtacatgattatttcaatatttgagagagccttttcaacttggtacaattgggacacccaaatggaaagaaacagtatgatcaaaggacctgaataggtgggcacaataactgaagttatctggccaattattaagtaacacttttttagaattcctggggcctggtcagcatgtacgattgaccataaattgttctggtcagcatagttattgacaactccggaaactatctgataagacatacttgggacctgtttgtttgagattataaatatgtttagattataaccccaaacaaacaaacccttcatattcctaaaacaagtctaaaatttaattaaatatataataaatgttacatatgctatttgtcacctaggtgcgactgggtgaagcttcacctaggtgacaaacaacgctggcctattaaatatttataatatatgattaatattcttagatagatcgttgaaatcaattttacaataa

SEQ ID NO: 5101 - DNA, 1752 bp, Zea mays
  misc_feature (1)..(100): optimal_loci_286489_G1, chr8:123307173..123308924, Cluster 31
tccctccgtcacaaagccttcacttggttgagttagacttcgcttttcctctgttgtgacttgtcctgttcatgttataaatgaatcgagcgagggggtgggcgaccttcactccaagacttaatataaaatgttgtagaataacatggaaattagtttgttactatcgtttctggttgcaacacaacccattaggaccaagaactctttgaacatccactcataattcattaccttttcatcacgcattaagactcttgcaaaaatcggagtgtaaaaaatattaacattgacaaagagtccaaacaacattttgtataagttcatataatatgtggtgtcaattttcataacattgcaaaaaatactacaattatgttagttcttttcgcttgccaaattagggtttttttgatccatgctatgaagactaggcccaactaaatttttggatatttatgtgtcttcctagtacatagtgacctactatttaaggtatgtagaccatgatccaaaatataaatgccattttatgcaataaatcttgcttagcatcatattattcttatataagtacttgagcatcgatccatcttcatatgagaattttattatttttgttcatcatttgtagttgctatagattttgtttgtgttccttttacatgtattgaaattatattatcatcatcaatgcaatggagaatgatcattgtctcatggttaaaacctttgttcttacttttaattcgtttttgaaaaccctacatgacaaaaatacatttaaaaatttagtgatggtgtaaattactatattcaatgttatggttgtctcatattgtatcattaatagccaaacataattatcaacctctacaaacaacatacctcataggttaataaccatcattgttcttgttaatgtttcctttaccaataccaaatacaacctacaatgagtaatgtttttagaactatgaattatctttcaaatcaaatgttaaattaggagtggttaaataaaaacctacaattataccacctatacatttgaatcatatcactttctcattgtcctctaaattgttcccattctcagtgttgctacaacttgcatgttggtgccacctttgatcctccttaaagaataagaaaattagttttatttttcacttgtacaatgatttacattatgcacaatgtgaatgtgaatactaaaagtgtggacacaaataaatattcaattacctaactggtacatatggtcgtgtagtaagatgaatgttaatgtaaatagttacattcaatttgaaccttttattgtatccttgtgcatttgttgttgcagcatttattgccttatgctcattattgtcaatgctagtaagttgaaaagcttagtcattattttatgtgccttttacttcttgaattgacatcatctcctaccttgaccaaatcaatagttaagtaaaacacaaatattctagtgagtccatgtgattccttttggttaggcatgctagttttgtcggttaagcaccatataccttctgaagttatgaaatgccacctccaaactcgagtttctaacatctcgtctttaattttctttttaataattatccctattgccattttcaaattcataattaggtaagtaatataaacaaaatatgtttttttgtaaatccaatagttgcataagcataactcttgtgtgtgactgcaacaagttttccctcttccaca

SEQ ID NO: 5102 - DNA, 2850 bp, Zea mays
  misc_feature (1)..(100): optimal_loci_286490_G1, chr8:123309122..123311971, Cluster 31
atcttgattaactcttttcatctccattgttagctctaactagcgcggcaattgctccctctatcctagaaacactcacaccacaaggtaattctttgacaaaacaccctatacctacacaatcatatagtagtacttcctctatcatagaaacactacatttctagcatagtgcttagtaaaatcatcttttgtttgacctgattttatataaagggcaacaatatttatcatactaattaaataaacatcattagatccgtcatggaatatattttctatatcgtacatatttgaaattctaaatgatactattttctaccccattctgaattgaagtcattttaactttttatattaacaatttactatgtattcaaatatagcatatatgtagatgcataacaaaattcatacacctataaaaccctgagtaacctatatttgaaattgagggagtaaaaagtttatcaaacttcatatagtttgacttagaccaaattcagaatttcattcttttttagatggaggtagtataaaaatgattttaaactatcaagttttacaaaaaatctttctatacttatatgaaaacctagagagggagaataaataatctatgcacataattgatgactatactgaacaaaatataacatcactatatataacatgcaatatacatcccacctatctatcacacccaattcaaaattgtatgaatcctcatgatagacatagcatatactacaaatagatgtaggatgaagtatttagaagcaggagcttcagctaatatttgcactaccaccaataattggcattttcatcgagaattctatagtagggtcaacttcattgagaattctttagatgcctctcttctcttcaattggttattgttgtcaggaaaccttggaaaacataagttttccttttgactcctcctgagagaccaactcaacactagaaatttacccaggaggaaaataagcaattggatgattacagttgtgtgctatgtaataacaacaaatataatttggccatttttgttgttaacgtatgatccctttttaggtgagctttatatgaatccaaaaacctaaatcaccaaatagaagtgatgtccaacctatcggttctccaatatctaagagcaatgtgtacatcaaccatattgttctaagtgtgatattggtatatcagccattgcttggccatcacttggacttctcttagataaatgattaccttacaacgtcttttgtgaagtaattcacaacaaccaacatgaagcaatacccatttgatgacatgaatgtgtcccataacaaaacctttccatgatcaaaatccaagcacttaagaaacaaagccttgattactctttgatatagcttatgtgcaagaatctaaacacattgcgtccaacactgtaatgaaccttagcacttagatcataaacaatttataatgggaatcttccatttatccaaatcaaccctgagctcactcaagaaaactttgaggtgattttgagcatcccctaaaaatagccttgtttgcctctggtagtagtttggctggttcatcttgcacacctaaagccaaattagtagactcgaccttactagtttttgaaatcagcttggccaattttggcatacaagtaacaattgagtgtttttaaactagcttttccttgaatcaaaatttatacccactaatgttgtagtttgatacttgttgaaccaatatattaacctcactggtttcatgtcttggaataacggaatttgaatttggcaaaatatgtagtgatgtcaaatcatttatcaaaatgcgcattatgtggtctttcaaaatattaaatcatgcatgcaacttgttgtatcatcaataaagaattatcaaggtctctatcatgtttcaccttcatggattataatatttctaaggtgaataagaaacattcacaatgggcatgaaaattattgcaaatataatttaattgtctagcatcgcaaacaccaccactataagaaataatgattattccaacaccttaggctcctttgtaagcttattaattactttgtcacatccataagataaatttaaaattcctctatcatgtcatagactttaaagccatcaaagtaaatttatgaaacttctcctcatagcatgatagttgcgagcactcatcgactatgattttaagctgacaattacaaaaaattggccatatgaatttatccacatgagcatgcacgacaaaaatgcaatatttatctcttaaagtagtaaattattgataagcaaaataatttgacaaccctccacagtataaggagacactccacgcatcaatataaagatataatggataatcaaatataccagaggatggattccatgacataggcataggcaaaaaatggataatgcaatgaccaataattttgatgatttagcacaagcctccaacttgggaatcgtttgtcgaattttcttctttcctttaattttgttgcactttttacttgagcatcatccgtctaagcttgggcacgccttttatgaacctgcaccaagcccttttgtttcaaaattttctaaaataagattcaacatcttattttcttgtcactttggtaaaaccaaatgagcatcctagttttatttctattttaaataatggtaaatatttcttgattttgggcactctcatctccttttgttcagatttagcatgtagaatgttaacaaatgattttcctatgtatttggcatcgatatctagatttttcaataatgtaattgactttccagtagttgaattta

SEQ ID NO: 5103 - DNA, 1776 bp, Zea mays
  misc_feature (1)..(100): optimal_loci_2883_G1, chr1:14816487..14818262, Cluster 31
agtctctttttctatggcaaatttattttcccgttgtgttttagtctttgtgaggtttggacatgttgtctactggtttggagacctccagatagggggggacttgttaggctcttcctcggtactgccctttgtagctgggctctcgaagaccctcatctattcaaaaagattctcattatggttagtctgagaaccatcagatcaaaatcttcactcatcggcaagagtattagttcagctcactaaaactataagagctatgcatatgcaaaatgaaatgaccgagagggaatgtagcacaacggtttctctagttcaaattttttttcttgtttgggaacaaatttctataagccgcctcaatttatttaactactctatatcagccttaaattaattttcgtctaacataaacaccattttcttaatatcaaataatatgattacgtgttgctaggatactaagtttgttttagagaagtgctacaaaaggagtttaaaaaatatgctacgaaaaggagttttgtgtgtattttagttaaaccaaggcacgataataaaaacaaacaaacgaagcaaaagctcttagaatatccctttctacgaaagaattggcaaaactgtaatcctttatataactagaggggaagactttcttatagcttatataactaaagtgagttaatcaattaaaaatggagtagcaccacttcgagaaaggattttagaaaaaaaaggaaatgatctcggcagtttgtggagattgtagctgtaccactacacccattataaactctatttttctaagtgggcaacgtctttctcataaagaaatcaaccatcttggccactgcgtcatgcaaagatttgcaggaggtgttcattgttattactaaagcacaacctttttcttcataagttgacaagatattctatgtttcaaggcctcagacactagaaattagaaatttaaatatgacataacaaaactagtgaatgaccatttctttcctttgcaatggcgaatctagcaaaataggttaggtagtgcttctcctattatctttcacctcctaccaactttttaaggtcccatgcatactaaattatagtggaggcttagaaggacttcgaacagttgtaactttgcaaggtagcgacggcttaaacccacatagccccggccggtactgcaagttgcaactttgcaaggaagccattcaccgcttaggtctttctaaaaccttgctttgtctctgttatttgctataaacctttctgtggtgcattatgagaacttacccaaatgttttaacggctaacaaacattgtgacacaaaattggtgaccatcatgagaaagcatatacgcctttttctcagctgccatcttcaactttatggttgatggaactccggagctaccaactcgcagttcataggttgtttaggctccagttttctgtgctgtctcgcaaaacaaaaaacggaacatgtgccctagccaaagtagcaacgaaaaggtttgtcagatgaacagagacacgaaaaagacgtacgcacggaacctcagggaccacgaccaccttccccggtcgagcctgtttgtatttatatgagatgtaacagttctccatgatgaagtgacagcctacaaagaaacgagaacaatcacatgagaaacaaataatagctaggttgttttccattaagaaacaattaaactagattagtcacggagcaaccaaggctgcatacaaagagaaacaaccat

SEQ ID NO: 5104 - DNA, 2344 bp, Zea mays
  misc_feature (1)..(100): optimal_loci_29158_G1, chr1:178391463..178393806, Cluster 31
ttcctttttagataacaagactaggtgtctacttccccacccaagttgcctggggccaacattcattaaatgtacattaatctgattactaatataatgtactaccaaatgcaagttcctcctataggggcctatgcacactaaaatattatccccttacttcttatttaaatatacttggcataccatggtattaacttaaagcatatatgtgtttgatagactagggattgcaccaagtatcctaatcaagggcaaataggcaatgccccaagaaagacaagtttcatggtacgatctaactctgcatgataaaaccccacggcttggctgaatccatccatctatggtgactcttgttatgaatgcagcttggtcaaatcacacagtgtgccaagggttcttactaggccccaatatagttttcaagataccatagagtaggacatgctacacgtatgactcgatagaaagaattttacaatttttctaaccagcaatagggaatatgaccaaaggtggcccaaaggcttttccgcttggctaagtactcataaacagataagtgtctcatttattttagtacccacattggggacccaattttgcttgcgcacaaaatcccctacaacaagcttccaaaactagtagacggctagaaaccattatgtagttgaggtcataatagaactttagtaaagtcaagtcctatcagctcgagacccttatttgtatacaaagacaatgcatatacccttatttatagttttaaaaacacttgactgcctaggcttgacctatagtttccttgagatctaagaattagattttatgtagcctaccatgaatgctcgagaccccagaaagatctatgtgcccctgatgtgtcccaaaagaccctggctatggttgagaaatcctactagcaccaatgaccttagacctctaggccaaaccctagcgaattcaggacccttggtcttggaatagccaatggtagctcaaatgtaaagacaggggaaactaccacacttgacaaataccaaacctctcgtcatgtggtgaaaatagagtttgcagggatgcctacaaagaccattgtcctcctaggccatgatccttttgagttggactgcccatggcatatcctatggcctagccattctagactaatgtttgaaagtggtaggtgtagaagcatgaggcggagccatacaattgctaaaccatggcatgtacctattcaacaatgatgtgtgtcattctcgtgtggcctgtcctccttccaacaccaccccataagccttaaaataattctaaggctatgggatactgaagaagtcactcaaaatgccaatactgagcgatgaggagcctagcttgtgcaatgagcactgaaggtctcgacaaacacctatgttggtgcttgtcaccatgttatcatggaccatacacccttcaaggccctagacctagcaggttctagtgacaactaacttaggacccccgaagtctatagtctagctagcacttaagcgaaccttggactcgcttcaaagaataatcctcattgatgtttacccaaggagatgaaaacaatacacttgttgtgtccctaatgacatgtacgatagatattcattgtatcacatattggttgggaagggcttgatggtaggtagggcccaacctaacttaatgccctagggacatagctatgaccactcaggttaggccttttcacgcttagccacacaaacacaaatcctatggcctcactatttcctcttttttggtataactctatgacaaaaggattaaatgacacctatataagtttttccttaagaatggactgttaggacaacatacctagggcatgctcccccaactatgtttccatgggggtcctagccaaataggcttggtgtgtcaagtagaggcctaaggagtgagtttttgattgactaatggttgagtaagatagcatagattaggggcaagaactttatggtgttgaaaatctccctataggaaggatacctatagaaagataagtaccacacttccattttacataagttattattggtcaactaatttatccttgcaaaagctcatcattagcttgccctgcacacctttggaagaaacagatccttgctttagagtgttgtactttcaaccttctgtttaaacaaagttggtgagcctttatgggagccaaagttgaactagtgtatgccagaaagaatctaagctaagtagcctcacaaaggttcgaaggtagtgacccagtaatggctaaaacatggtatcgagctgctctaccaacgtgactcgc

SEQ ID NO: 5105 - DNA, 1508 bp, Zea mays
  misc_feature (1)..(100): optimal_loci_293827_G1, chr8:161863392..161864899, Cluster 31
agcgcccgcagtttggcgcctttgaccttcaatactgggttcatgattcattcctcttcctgtccttggatggcgacgtcgttactgggacccacacaggcacaaccacacatccactgagctgttgaggacctgaggtgagcatcacttcgtgagcttctctctcgtcttctcctgcttctatctgaaactctggttgcctctcctatttggtctttagatattgatgaaaatgagatatgatgaacgatatttatgtatttatgtgaactgtgaagcacatgctagttgctaaattacaatagacagagtaatagaaaagagatgcattgttgagaaattgatgtatcacattttctctttgtttatcaatatagacttaatcgttgattgatgatttacaccagtacaaattgatacattgcagtacagacttcatgctagttgttaattgatatacagatatactatatctcttgtctcctctttagcctttgatgcattgttgatgtcttacatttttttgtcttttggttgtttaatagccaccaaatttatagttgtttaccaaaatatttcttgtattgtacagaattattatatataataaattaataatagacttggctcttggtacccaaagttaaaattctggataagccactgcaggcatgaaaggctatgccccattaatttctactctggtgtgcttgaacttatgtgtgttgcttgaatactagatctatcaatctacttcaagaaattgtataattattaggtacctactgttgtaggggtgttgtgaaaaacaattggtcgatcttttcattgtttgtgcttactagtgaatagatacttgctccgatgcagtcctcattttgcttaaggcttggttctgagtggatagcattggttacaacaaaacaattggcaacaaaacccaacttagaggcggctagcattttggggcgacctcacccctcacattacctcattctgcaccttgctgcgtgatgggcctgatggcactggcacttccattgcaccctgcagcgtcatccctgattcagaactgacaccctgcagcctacagattgagaaggggagccaatgaattgcaccagttccctgaccctgagtctgcttgttgctccttgacggttcatccacacctgtggtggaataagcatcgcccacagtgagctttcctcttcgttccgtactcttgacattgacaaaatttccatttgtttctataaaatggaagcaaaattgttgcactgtgtgttaaatgggaacacaatttctgtgggtgtgataaatagaaacaaaactactgtgggtatgttaaatggattgccctggttgtatacaatggtgatgattttttttctttttgttgtttccttttgcgcttcataacttatgttttataaatgcacatatgcaaacctctaggttggttttgttaccattttcttttgccgtaattgatggtattcacccag

SEQ ID NO: 5106 - DNA, 1435 bp, Zea mays
  misc_feature (1)..(100): optimal_loci_295655_G1, chr8:170459341..170460775, Cluster 31
taacaaccataaatatttcataaagaaacaacacaatataggaaggatgtggagcatgctttctgggtcctacaagcgaagtatgtcgtgatgaagggccctgttcgggtatgggatcaagtaaacctcaaaaacattgttgactgtgttgtaatattacacaacatgagtatcgatcacgagagagacatggatcagcttagcttaaggactatgatcaagccttaggcccatggtatttcccccaacaaaaacaagctagaagttcaaattttggttaaaaaatacttgtgcattcaaagcagggaagcacacaataacctacaagcggaactcgtcgaccatgtttggaatcaatttggtggacaataggccagtcaatgtaattacttctacactaacacatgcaattgttatggtctgaatttgaatttgtttttttgtaaaacatgatgcaggtagtgttcatgtactactacttggatgggaaactagctaagatgtagatgctcccattcatgttgcacatgttcggagtcattgttgcactacaacaaagcaaagtacagcagatgcatctgttagttgatgttgtttgtgcacttcttcagcatgttgtacctactgggcaagtgaaacaatgtactgaattgtatgtggcaatcactgctcttgtatgcctgccacccttgcaactgatactcccatgtcgtcgtcaaaggatcgctcgcctttataatctcgcgcccaactatgattatgccactcccctatagtttatcacctgaatgcgctaaatagggtgaaaataagtaaccaaattctcgaaaatgctaaaggcaaaaaccctcaactcaaccatatatcgagatttgaacttctcaaaaggagaatagtggttacatcaatatttgtctaagatgcgggatttactgataaaatcccattacaaaagtcaaaatgttgttcatcaatatttacaacaggaacggtgtaatctccatgaacaacataaaaaaattgacttccaacaaaccatgtcataaacaatcatctcttctaaacactaatgatcaacgatagcatggttcaattatatcaaagttcgacaaatatgcaaagttcgataaaagtacttaacacattgacaacgacatagtttaattacaacaagtttgagtaatgctaaaagttcgataaaagtactcaacataaccaacttcaacatattatcataacaatcatcattcttgaccattaccctcactgctggaggtcctgatagcaatcttcttttgtctctcaatgtaatagccacatacccgaggtggcagttttccaatgttttgtttatctcatcttcctccctcagctgcaacatcctctgttgtatctagacattgcgctatattgcatcgactttccttacttcaag

SEQ ID NO: 5107 - DNA, 1745 bp, Zea mays
  misc_feature (1)..(100): optimal_loci_298133_G1, chr9:5661645..5663389, Cluster 31
atgctataatcagcattctcggtaactaagcatacgaacaaagatctagttcaaactagatatgtggtaacatgtacctaaactattataaaccttatgttttatgtgccatccttctagtttcctatgcatagatatattgatgcatattgttagagtaataaatttcaacaattggcgtgctaggtagtggtattttgcatataaattagttgtctcaaatgggtcatatattcaacttcattaatactggcaacaaaatcggttttagcaaactagttttcattgttgactagctcagggaacttgcacctgcagggttcgaaaccatccacgcaagagggggagtagtcgcttgccatccgcttgctaaacgccgagtttgaagataaaatggaagaagggacatacaacatagcaaccacatcaattccacgctcagaaggccctcactacatttgggcaaaagaacctccttcactaagccttttgtatcacggaagatcaaggccatgtccttggcacagttttagcatcgctacccctatacatcccatctggcttctccactggacacatggtagcttatgcttcttagctttaccaagccattgatgaccttagcaatataggttatgttatcatcaaggatattgacatggccctaatggatgtaatgttttaccgatagagaggcctatgggcatattttctaccatgtttctaattgaggaggttgttattggtttgaccatcaattatgtggtggtcaatctagagtaaacacacatagtggatacttggaactattacttgccaaatacatagataaacaatactcgagcaagacaagattgcaagctttttcacttattcctgactatgtcgaggggctcgaggattgcgtatattattaattttaaggccatatgactaagttttggggtgtagttaccactatgtgtgtataagctcaacaggtggtactctgtcatagtggataggattaaagttttttcaccaccatttataagtgattcacatgtggcaaaccactcaatgacaaatgttatttgatcattgccatggggtggtactctacaaaatgtctaaggatgtataagaccccaataatcgattttgtatattcgggtactcggtttttaggctcgatggcatgagacatatgtccttagtggatacatttaaaaacttttgaataatagacacattaaagttagaagattatagaattgaccctcaagctcttggtgataaacactgaggcttggaggctacacctagttggtacgctttgcatcaaagtgcacaccttttgaagaagatttaaagagcacttcatggcttcactctagcaggtactcaaatacttcttgattctacatagagataacatggaggtttaagaagacttcaaagttcaaccaagaagagctcgagggcttgatggaccaagatcctaagggttcctcattgtggtgtgaattccatgacaaaaagttgtgtgatcgacacacaaaaatgctaggaagacaaaaaagtggtgtgaattccatgacaagcaaactaagttagtcagctataggaaggacaatcattataatagaattagaactactctatcatacacagataggactagaatcatgcacctatactcaggactatatagaggtagtggtactccccttgtaatagatcatattcaataattcgacatatgg

SEQ ID NO: 5108 - DNA, 1501 bp, Zea mays
  misc_feature (1)..(100): optimal_loci_299825_G1, chr9:12377823..12379323, Cluster 31
agagttttcctagcaactaagtatgacgttgaggacgaaccagtagatagttttcccttccctaaaaggaggttattagttgttccaaaaaaatatagagctagaattgtgaatctttagagaacatttaggtaaatccttttgtatattatttgaataaaaaatatttgtataaattataaaaatttatattataaaatacaacttcaaaatggagttggaaccaatcccatcaacattgacaaatatggtggcaagaaggaccagaataaatggattcaatgctactcgcttgactttatggattaagtgcgacaacaaaactagtaacaataaaatttccacgctaataagtctttttgtaatatcaactttagtatcaattttaggcacaaattaattcataaagaaatagaataacatgacatatgcgatcgagattaacaaaattatggtactcataattaatctagagtttatcacaaagacgaacccgcaggcaaggactagtgaatagaaaattaaggtatgaatgtataccttgcaacagggtcagtgttgagagcaccagatgcgttgttgccaactaaagtagccatactatttagttggcctcaaatggtgtagccatacaagttgttgcaaataaatagttgatgatatacaaaccctaatgaagtagtcattcacgacctctaggaagtagacgtatagtatgaagatgctcccaaacagagtcgtggtaatagagatacaaaagtgtagcaaacaacaggacacagaggaaaaaagtcagaaatctcttaagcagagtacctagagagcataagagaagcatgtctcttatatagacacgggataagctcatcttactaaacaagaacgtcctccgatagagatgtaatcagattgaatacaaacgaatattattgaaatcatatttatttttgtatttttattcggattcaaattcgaacagaaatctcctaggtaggagtacataaagagcataagagaagcatgtctcttaggttgtcttttatcgatcgtgtaaaatatggaacatgatactgtctgcaaagtaaagtttgaaatagaaaaaataggtgatgtaatagtggatggagatgaccttatatagacacacgatgagctcgactcactaaacatggacgcctcttgcctctggtgtatgttgatgatcatcaaaccgttaaggcatgtacaacctagagcccatagaacaattttctaaataaaagagacagctaagaaactctatgatacaaccatgcgactctagatcataaatgcaattaatagacaataagtatagcgtgaagagacgggttcttcgcgaagagcatgtatcttgattttttcccttacccacctagagacttctcaacaaacgcatcatttaaaaagttgtacatgcccttagcaactacagccggaccatttacactatagttaccccttttctaccaaattaaactct

SEQ ID NO: 5109 - DNA, 1605 bp, Zea mays
  misc_feature (1)..(100): optimal_loci_301076_G1, chr9:19950415..19952019, Cluster 31
gtggcggctgtccaatgtttaaggaaataaccttgtcgacgatcatgcggctgctagctagctaggacctatagtgtctggctcacatgattaatttcttgaaatattaggcggtttaggtcaccaacagttttggcaattatatcacgaaatagggttgttagatcgatcacgcggcgaccacaacgacaagagagtgcaggtgatcgaaagcgtcaactcgacgtccgaattgtgtcatgcttatgtgtggcgccatgcatgaaataattaatccaactaacgtatgtacggccaatcaaaactagctgtcgtctttgttgccatagtacgtagatgtagatttgtgcttttgctttgtcctcgctagtagttttaaactagctgcgtgtataaaaaaaacaattaaatagcatatatttttaccgaacaaatagcatgtgatttgcagtgtggtcattcatgcatgcatgaagcatgcatgcagcatttggcgccgaggttttcaaccatctggtctcagggtgcctaataatccaatccacatggtgagactgctcactgccgttggttgaaataaagagggaggctaaatctatcagaaatatccagcagcggcttccctctccctccgtcaactttcgtggtcgattcggtactgcgagagtcctctgtcctaaccttgaactgtgagcaagcggtatcatccatctctctctttttttaatggaattacatggagatctacatacgcgtgcgtgttgccgtatttgttatgaaagtgaaacgtctgaattgctgttgaactacgtacgtacgtgcaagtggtgtcgcgtggttgtagacttgtaggcacacacatgcatgcatgacaagatttccttcctagcagtaataattatcagaggggccaacgattgttctaatatttctcaagttgaaaaaaggcactccatttagttgtgctggtaagaaaaaaaatcaaaaaaaatctttgcctcgaaatttcctgtacaccaccgagtctatatatagtctgtgttgaattgtagaaaataaccaatgagtttggtctgagaaccttgagctgtgtagtagggaggaggtcgtcccatcagcatatatgcagtctgaatctgaatttcgatttgggcagagccgcataggaccgcatactttctgcggccgggtacaggcacctctcgcctcgccgtgccaccgcatccacttccatggtgtcaataaaaaaaaaacttctcgtacttcttggcaaggtcatatatgatcgaggagagctagcccattttgaacctgccttttttttctatgcatgctttttctttaacaagaaattaaaccgatgaagcatcgctgtcacaaataaactcgttggccttgaagagaatttagcgccttctatctcagcatttttttttctttctaaaaaaaccatcagtatctgatctctctactaacctccaagctacagcacaaaaccatgcagggcttgtttcataacatttgcatgagtagactaggtctactaccaagacttggctgaattcatagtccaacgtacagaattcatcctatatataatataaa

SEQ ID NO: 5110 - DNA, 2254 bp, Zea mays
  misc_feature (1)..(100): optimal_loci_301773_G1, chr9:23465509..23467762, Cluster 31
tgtcatttgatttaattggtaaataaataatgcatccgatcattttaaattaagtccaactcccgggaatacagaggaattttaatttcctcccccggccccttctttatatataatcgcgttaattagctgaacgcatacaaaaccaaagatgactccaaatagtagctggcttgctgactcaagacgacctcacaacgccatttattcgtgacgagctagagggtagctcgttggtgtcggctagtacactgggttcattggcgtcgaagaaacggtcaaattacttcttttttttaaaaaaaaagagaggtgatgcataggaaactacgtactctacagtttactatgggcctgctggtgtgcccaccgaaaccagtgatgttcgtgccgtgcgtcttcctgcttgctctggtggtacacgtagccagtacacagttacagatgttcctgttctgttctgttgtgttctgttctgttctgttcttcagataccatactgtatctcatatctacaccgcaggcgttatggccgtctggaccttcttcttcaggcggcatcgcatatatgaatgaatgaatcatcaacaaaactccagtacataaaacaacatgttgtcatttaaagctcgctcaggaaatccttgatgccatccacaaaactccagcacataaacaacatgttgttaacgatacaattgtggctaaaaagactccttgtccttataatttgccatttatagggaatttcgtgtgcttacgatttgccatttattgggagcccggcctgcctgttgccccgttggctgatgctgacatgcatgccctttccaagttccaatcatattcaagagaagcatgccagatagtaagcaggaaaccaatcgatgagccagcagcagtagcatgtcctgacagtcaggttcttgttcgttggtggcgacatttaatttggcagttttttttttgttattataagcacggccatcggcgtttattaggtacttcttgttttctctgattttttgttaaactcgcgataatttaggacagagtgatcatgcatatatacattgatgtatctgtgtgtgtatatatatactagctagtaccaaacaaacagaggtttgccgccgtctgcattgtcagttccttgcacctgcagcaggactctctctctaccaaagcaaagagcgtgacagatcaacaaaacatgggcatcaagcctacgatcggagatttcctaccagatccaaccctacaagattcttccatatatctcagtcacatcatcagcagaagtaaacaaataaatgaccatacacatatatatatttagcttaattaggtgacaacgttcccatgcccaagctcaagtaggaaaggaaaacgggtggcaattagtaccttgcctacacgctagagcaggagcagcagatgctacaaacttgcaatcatctcccgatgcaagcttgttgccgtcgttcaccggcggcgacgattgggcaagtccgatcaacaagcgggccacattgtcggctactacacccctatgaacaccccccaccccttcacatctttctaaaaaaaaatgtgagccgtgtggcttcgtctatacctgtgtggctgtgcataatgaattggttgccccggacaggggtaacaaggctagccaatagctagccactctcaaaacacaaaattgaacttgtaaagttcataattacacagaagtggttacgcgctgaacttgtgtacgtattctttaaacactttcttatgacacctcttgctgccaaaaattgtatactacataagagaaaccagccccatgacacaaattataatcacatgagacagttgccatgaaggtctacacaaaaattataattacaggacatgagagaaatcagctacgctaacttttgctagattccggaccgttttttttttaaaaaaaacttgtaaaacgcgtattaaagttattttctattgagataagggcacccatatatatatgagctgattaagatatctaacattcaattcatataaaaatacatgtacagacttttttctctattagtgaggtgcgtcagggcgtaagggcccctaaggacttattacccagggctgagggattcgtgcacttatcagtgacgtgctccgggtacaagaggtcctagggcctatcccactatgtgacctaggcataagaggtccaaaacttatctttgaggtgcgtcgtggcaca

SEQ ID NO: 5111 - DNA, 1511 bp, Zea mays
  misc_feature (1)..(100): optimal_loci_307528_G1, chr9:61813546..61815056, Cluster 31
cacaatcgccagcaggagttaccaatactatatatatatatatatatatatataaagagacagcgcagaataaacaacagttgttaataaccacgaggcgcatcgcccaagttcttggatatgtcctcgtgtggctataaacttgatgcagtacacatgtacttgcattacttttgccgtctgccaccggtacaaagccagctaaacagacactacctacaagtagcctgtccgctcttgtatttcgttcatgatgaattagtattaccggctggaaacagaagcatccctttcagttctgaacgcaaagatgatgcatgtttcacacctaacttaacccaaaacatcacacacagcttttttgctataccaaaatagcacaatcttcttccaaaataatactagcacacgtacacgccacaaacttttgctactagaaatgaatatgaaaactgaaatgcaaaaacacacaaatctctggatcactgatctattcacacaaacacatctagtcctcagctcgcccactccatccagcaatcctggaatggaatggtacggacgcagcaccactgcaccaggttggatgagggtaggttgctagcctggagccgtacagccttacaaatccttcatttcatgcgtatcagcagcctcagggaactggaatctgagaaaagattgaaggctttattgctctcgcttcatgtcacagctgtcgggttcacagcaattttccagcgtcctgttccgaggacagctgagcagcggaagcatcctcatcacctcccctcatcctccatccagactaccacctcggtgccccggtgaccaggtcccttgcttgtccccggcaaggctagctgcagcccaccacacctaccggcatgcctgttggcgccgccgggggcttgctctgacttgttctgccacttcgccacctttggctgacgggagctgcaaacctagaaatacgtcacgtatagtactgaattaactaattaattagtgtcttcgtcacaaactatgtgaattaatagaatctgatgtactctttattcaaattgtaaaatgttctcgcttttctaaacacattttttagaaagagtgtaaatctaagtgtagagaaaaatatatatccggaaaaaaattctttaatgcagcaggtgataacagataaatgaatctggtggagattaaaaaaaagcgatcatgaattttttttactagttgctagatagcaatgtaaaaaaaatcgattgttgtcatgtccccttgataatgtagttgtgtttgacacatttgcctgtctagtaggtctcaaggagaatttggggctgcaagcactctcacggagataatccgcagaaaaaatttccagaaaggactccatgcagttacacatcaaacttgctctcacaaaatcacaatattttggtcatacaagtccgtgacaaaatttttcttcttcttcattttttaaactattattattattatcgtatatatat

SEQ ID NO: 5112 - DNA, 1825 bp, Zea mays
  misc_feature (1)..(100): optimal_loci_309307_G1, chr9:73229774..73231598, Cluster 31
cagtgtgctcgctgaccgatgggccccaaggaccaaagatcttatccccgagactactactaaatatgaattggaatgagtattttctccctagtgtattgaatgaaagagagtacttttagtggagagggagtgatcaaagtggtccatggatccatgtgaccaccaagatcacttgatgttgttcttttttgcatgcttccttgcattgagtgttgaaccttatggcaacatctttgtgagtgtgggaccttgtggcaggtggggctaacccatttgctataggtggagccaccaccttgagtgtgagaccttgtggctgcatccttgtgattgtagaagatgatgtgcaaagtgatggacgtccaaatatatttgggggtcgagcgacccccaaaagtagcttgtggatcttcccctctagtgtgggtcctctttgcttgctcttcaccaaattacagcgcatgtagccaaaattcataggtcagtcgattggctaattgtggctaaataggaccatcttttgtatgtaaccaccataggccaagactatcataagccaatagatcaagttaggttccaagcatggttttttgtacactctatacctacatccaaatagaggacatgtacaaatggaaccatgtaacttgaacaaaatttagccatgttatcctcatgtccttcaatggtgacactttgtggatggttttgagtatttaaaaccatgaaggaattaccgtcaacaacaatgcatgatgataatgagactcattgcattatcgtgatgtgtcaacaacatgtgtcaaacacaagggctaccacatcatggcgatggtttgataacataaatgggttactaatgagtgcctcaacaaggattgaggagtgcccttgatgaggatgatatctatcatttacaatggatgatgagttaacaatatgagctacaacgagttgacaatgcaatacatcgagtgaagaacacgagcagtagtgggtcgatgatgcgaggcaatagtgacgaaggccactatttgggtgatgatgagggtcaatgagccccgttgatgatcaataccatgggtccatgaatattgttattaacaagggccactatgggatgacgatgatgagttaacaacatgggtgaatgtcgagggtggttgcatcatggtgaggacgacaaacgtcgagtggtcgatgagtgctctcaatgaggattgatgagtgccatccatgaggggtagcaatgagtcaccgacatatgttaatgatgggttgatgatgctcgctaattttgttgaggattaatccccatctcaagctcctgggattgatctatgcataaagacccctccctgtgtgccaattgttcgaattatttactttgataatatgacacaacatatcatgtagaggaaatcagaaggatagcacatgcttgttcatattcttgagtttacaaggagatataagaaaatctgaggagatactgatcgggggctccccacactttcttatatagtccacttgtagggttatagatagagtcctgataatacatgtggatttcctagtttgttatgaggaaatcaatcaattcatgttggtaaatattgtctttcaagtagacgaggtatcctgtctaggttgggctccttgcatagtcaacttggtgaatattataccatatgggttgtttttcttacggtgagatacccttgatgcaaatcatcaacacaagccatatgtcaacactcaatgtgaccaacttgtaccttgtactatctccatcttaaaaatctcattctcacttcccaag

SEQ ID NO: 5113 - DNA, 2141 bp, Zea mays
  misc_feature (1)..(100): optimal_loci_314277_G1, chr9:102371773..102373913, Cluster 31
tttaggaggagaaaatgttacgagtagcttgcctaagagataactactctatccggttcaataaagcttacaatttaagtttttttaggagtcaaaattttaagtttaatcactacataataacagttgaaggacagggctcatatggtggcgagaagcctttacactacactacctatgtttaattaagtctctctgcgtagagattaagctcgtctcaattattcctttcttagatctcactgtgggagctgttagcacaccgaacgtttcactttgtactaatatttatactatacatgtctgatattaaataagtatattagatcaatatagaatattttcttatagtaagcttatttagagacaaatattaaaagtatcttatataaacttcaccagtcaaatttacgaaaaaataatttgtgtaaatatactttttggacgaagcgagtagatgaatgtaacatggagtcattggacagatatgttatgatacagtgccacaaagggatttcatagaaacgtcaaaagttgacaaaaaaaatgaatgtaatgtagggagggattatttcatacatccaaagccaaagccaaagccaaagatatatacgtaggaggctattgcactataagtttggtttagcaccaatgagaaatatataattagaacaaaatttaatcttggtcccccctataaatactcaacccaatgctacaaatctagatagagggcatccatcatttagaaagcagcacacgcagaaataaaaatatgaatgaaatggaacggagcaagtcaaatcagtccccaatctatagatttatcctagctatagataacatatatattcacagcatcataaaaaaaataatacagaacaggcatgctccaaaagggcagctaacagaagcatcatgaagcttaaaaggcatgtccatccacaggcaaagtgcaggccgcgcatacactgaacttccagatcaggctttaatgcttcgcttgatctttccctacaactagtcacgtaatctattgaattttgatgtgataagaacggaactaaagtcaaaaagaccaatgcgatcaaccaagccatcagtttttaattgacaacttaccaagattcctttatcccaggccacttttatcgattagttaatcttttcgatgctaatcgtagaggcaactatcattcctacacttcaaatcttctttggcctttcttgatgctctagctgtgagaatatatttgtgtaaaaagtgctttggacttttaatggctgttacttgaatggaacaaggcagggtccaacaaaggatgatcatgctcaagatgctctggatcaaactgatggtgacattaagctttgtaggcttagtggaagaagtagagagctggaaaccagcagcacttagggtgcggcatcttggaaggctagctgcggtcctcctgacctgtctatggatatattattagaacacatattgcaatagtaatctataataaaatgaaagccctcatcaaaaagcaaagttttggtcaactcatagcagatactgaacttcgtataaactatgagacttttcaaatttgaatagcagcaccgccacaacactagcaccatgtctatatattactgtatcatgtaataataataatcccttgaactcgaattttgctttaatctagaaaaataaattgggtcaaagcgaaacatgacaatatgaaataactaccttgacatgtaagttatgatcagaaaggaattttacatatgctctgaggagaatggtgaagtcttgcaccaaaatcctccaatccccactactaataattactggactcttgtgcatgagagagatgccttagttactggactcttgtgcacgctctattggtcaatagaaacgtaaaggatccatccacttaatcgtaaactctggagactatgagttaatatttgccgctagcaaagttaaagatcaagacctaaagaaaatctgcataaagtaaaaagtaacaggagatcctggtaggtcaaaaagcaaactcctaattgagatttctcatatcaccagatataagccaaaaagaaattacagtttcagctgaaaatttatggacgtagaacagcta

SEQ ID NO: 5114 - DNA, 2123 bp, Zea mays
  misc_feature (1)..(100): optimal_loci_320295_G1, chr9:134846186..134848308, Cluster 31
ttaatggataagtctcaggtgcaacatattaaatgtgtaatgggtgacattacatgcctggcaagcatgttgttgtcgtgacttaggctctagggaagtcaagatcactatgttgtacgtgcattaaccctaggttttagaataaaagtcaaaagtttaattaattatggcataataatgaccctgatgggtaaaattttatctctttctctagaatgtgtgcatgagtagacatgacttttcaataaagcaacatgctcctcatagctcctagggccctagggtttgaataagagctagcgaggcacctcacactatcaagagccctgaatcgaagcaaatacgttctaaataagctaatatgtcataatcagggcatttgcattgctaagagccatgactacaactactagtgctttccctttagccctaaaacatatatgggataatgtagaagactcttcatggtccataccatctaaggaccaaaaaacataagtcaccttcagctctaggagccttaagccactcgggtatcatgaagttacttcatggagcttcctaagctaagatccctgaacataactaccctcatggcctaagacctaaagggatcaccatacaatgagcaaggccaacccttgtggggttgaggggctagggcaaatacaatgaaacaaaataatagatgaatatcactaaagggaaaaatattgcatatgtcacaactatattacaaaatggctttaagccaaggttatagagaacaagggaagctcgaggctactaatcatcattgtggtttaacgctcttgctctaatatcaaggccatgctttgtattgtcaacaaagtttgttgcttcatgaattcatcgacttggtgctacctctatagtggtccttaccttctctttagcttgctaggggagatcctcctttagacctttgtagatgtcttgcaataagaggtttgtgttcaatctcttttaggtcactaagatgtcaagggacaccttgagagatagttatcgactctctcaagctagctgggtgtagactttgccctaaagctcgactacttggtcgcaatctacatgaatccaaggaaggagccctcatgctttccatagtatgggatccccccttctaaatccacctaaggtctatgcaaatcaggatcttcacttcttcactaagggcatcacatgctatggtattttcctccttccctgataccttgattaggtggagcttgtcctcttgatggttcatcttatcctctaagacctaagagccttgggaggatcccatatatgcttcctaaaccaccatcttcttgccttgagccttaaggttttcctcttgccgacgataatccctcactctcctttttaggcctatattcttgtcctctaacatcttttgagcaatttatagttcttgggactagtaaaagagagcttattctcttgagtccttctccttgaaggtttgctctgcctcttataactccaagagcctcttggttgtctctagatctttagaaatcaatgtttgtttttgggttcctagggcgatagatatggactcaagctcttgatggtggagctctaggtcttcattgttcttgactttggtaggttcccactcagactcctagttcacctgccctcaaatttgggctaccaactcctcaatcaccttgtccactatcacttacctctcgttagttgcctcaagtcgggtcattgcctcttgctacggtgcagcaacatctcccaaatttctttgccatcctcctaggcttgtactgcaatggtatggatatcttaggcctcctccttggccttttgggtggcctattccatttccctccttttgaggatcttgaatacaatcaccgcctaagcttctttgattgcatcctatagataggcccatgtctgggtaaggaggtcttggttgtccctaagcatccaacattccatgggcaccaatgcccagacctctttggtgggcaactatgcttggtccaaggtactgtcacgaagcaaatgttgccatgaatacggtccacaatttgctaacatgtcactgctctgcataagcgtcatctaaggct

SEQ ID NO: 5115 - DNA, 1702 bp, Zea mays
  misc_feature (1)..(100): optimal_loci_320988_G1, chr9:137993795..137995496, Cluster 31
ttacaagaggtggcttgatatgaattggttcagatgcacctcccacccaagcaccacaatcagaggccacaccgctcaaatggtcgacatgccctcgtgtccacatataaccttcagatagttagtcttaggcatagcctagagctactacaccaacagagacacatgttaatgagaggggtgagtttgaagtggagcaggtctaagacgtcccactattgtttgatcttcatagagccatagctagccatgtttgttgatatagacacatcacaattgtcaagtagttgctagagtagaggggccctaaatcaagagtactattcagcaacaccatattgaagttcttctatagagctcagttcctagagaggattgctctcaaggactataagacacacttacatttaagcatttcaattcaagtatttacattcttggaattgccatgctagtatagggttggattttagggtgtaaaactctttgacatatcattagacactcgagtaaagttgtgcttgtgattagggtttagtttgtgcaagaaactttagagaatcccaattcattccccttttgggaatcttgattatttcaagagatacaaatacccctccacttctattccaatagtgtagtgaaggtgtggaagttctacccttggaagcggaacttatgtgctttgatgcagaacttatgtacacacgcacaaatcttttgcactagccagaacaaggaaattaggcttagttggctttcttttggcttttggggttttttgtttgagtaaagcacacccatagaatctttcatttgttgtccccacttatagtatggtggttcctatagtcaactttagaatataaaataaagtaggccttgaaggatccaaacgttgcttagtaaataattatggggtctcaactattctcatacacctctgcatattatttgcatgcccatactagagaaatctcaatagatccttaattacattgtcatcaacacaccaaaacccacttaagggttgttgacacttcttgtggcaaataggtccaactgcaagtgcatgattgtcaatgtagctttcacccataagtattcctacgtatctatttccaaagggaacatgaatgttcttactaagaatcaagaccatcttatgacaataagttgtttatgacattttgggtaaagaggaaccataaggtaatggtagttggtggaggaaagaattattatgattgttcacttcaatgctctattttgttcaaacattgtgaaagataacttgtgttattacaactttaggccctatactttaagaacttgcctaaacacgcggtgtacatcacagactagatagggctatcaccaccaactaattaccacacatcccaggaacaagctacaaacacaagtaaataatagtctaagcaccattcttacactattgaacactactctaatctaggtatgaaaggtagactagagtgtttagagaactaagtaccagcaaacaatagtaaacacttaattaatcaagtaccttataccaaaaagaatcttagatgtagctcactagaaggaaacccgcattcataggcgagatacaaggtggagatggtgttgacaagcctaacactcctctacactccccctcactcttttactttttatacacttgtagattggtagg

SEQ ID NO: 5116 - DNA, 1606 bp, Zea mays
  misc_feature (1)..(100): optimal_loci_327541_G1, chr10:16507191..16508796, Cluster 31
aacacactatatatatctagtgaaaacgtcacagatatttgcacaataagttggatatacattcagcattgcatcaagtacgtttttctttcagagcataagtgccacagcactcagtcattgcatgaaataacaatgggcccaggaagtggatccaaataaaaaattcatgcttgtaagctgcaggctatttaaatatgacagactttctagtcgggaagcagtgtacttgcttgtaaacagaagaggacgatggagggggaaaagggatggaactgcgaccaaaaagtataccccacatcccatatactgtcgatcgcttgtacagcaagcacatgatattatttagttctaccgtgtcctagtcctacaaatgcttgttcaatcctgcattcatttgacaacaagacctctggccgtgggccgtgtcaataacaactcacgcttgaacacaccgagcaatcagattggatagttgggatggaaattatggcagtaagtttacactttacacgaaacagattaagagaagatcaggaaacaccatattaaaattattgcatgctttttggttcgagaacgaattgcatccggtttcatctaatgatgttccctgaccacatggtgttgattatatcaggcaagaaaataaattggaaaccggtcgaaagtcgaaactaaacctcaggctcgagcgagttacgatgatcatcgagaagcttcctaccacagcaagcacgcaccctagtaccctacggacatacaaagattcaagccagcatgcaatcaagaccccaacccacaccaccgacgatcgatctacccgccttccataagttaaggcccaattaatctgagcaagcgatcacagtaaacaccccaaactcagcaatcaatccgcagaggaacacacatgaagcgattgtggaggaagaagacggcttgcagttgcgacctagctatagctaggtgcggtgcatggatacctttcagcggaggaaggggacgaggaggtccaggaaacaagtcggatcggctcggcggaggctatagtggatcggaatgcgtctcgcctcggcccagcaaggatgaaaccctagatcatgttccgccggccagaagaagaacgccgggacgcggagctagctttttatggactcgtttcgtgtccagaccaaaagggagagcttcctccacttgccgttgacaggttggcttccggaccggaaaccttttccttttgtttacgtagatatatcctttccggtagggcttatccgcttatatggggctaataaccggctaattaagcttccagagtgtccataaataaaagcccctcgaatatgatcttttaaaaattagtttatagctaccctatccatcttaaattacagaaatttttaggtatacagattttactatttattcgaatatacagtatgtctagataaatggtacggtaagaaaatgattatctataataacttataaatttataatctagaacttataaacagtagatgagttttaaaatgtcttgtaatttatttagaactgatggacctacatttaatagagagaaataggattataagtgtgtgta

SEQ ID NO: 5117 - DNA, 1745 bp, Zea mays
  misc_feature (1)..(100): optimal_loci_328032_G1, chr10:19242320..19244064, Cluster 31
gtctaattagataaatcattcatatagtgccacttggggttgaaatcatatgcattgcatatatgtctatgtgacgcatgtgagagcaagcaaaaatgcttatttaaacaaagtaggagttgaaggtgtaatgaagcttcgatacttctagagtcgactttgaaaaaatactaggagaagaagacattcagggagaggaaaagatgtgcatgacacttcaaagttgaaaaaggacatggttgcacctcctcggttattacttcatatgaagatgtatactagcgtgaccctataaataggtaaaatgtgtcaatgatatacggatcggccattttacaatattgtgcctatagcaacttcctcccgagagagcctacaaaggtaatataatgttgattcttatttgaatatccctttttatctgttatatgatatctgaagtgacttgttcattgttcctagtaatgtcgtatacgaagctattttgtcaatgtcgattgtggtatgtaatgttgatctaagaatttaatgttacactttgctcattatttgaatgttctttggacatgtgagaagtgttgtcattattcccccttcatctccttcagaggtgagaagggctgagtgaaaccgctaaatgaccattcatatgtataaaaaaaatatgagactcttgcaagcagtaaaccgttcaaacgacatcggaattttcaccagtttttacatgttagcaatggaagatgatgatttgtttcatcccttcttccctccctctaggggaaaaaaggtttcttaatctaatggtgttgtcatatttttgttgtttttagaatttcgacaggtccccaacaaccaccaaagccaatcgcctttggatgccacttatttccaaagacctgttgatgaagaaagtactttgcatacgcctctagaaatcattttactagtagctagtgcatgacacttatttcttgatcaagcatgttttgaatattgactgattattttgcgacaagcgtgcatgtttggaatgttgacaaagcacgtacgttttgaatgtcgactaacttttttttgtaagtttattaacaaaatttcttcgcttttgaatgttgactacaataatatttagtgataggccaacgttttaagaactaagacgtttatgttcaagtcacgccgttttcagatgtcattgttgaatggctgctaaggtacggtgcttcattcgtagcatacaccgccatgtgtttggaaaaccgatccatcgtcatgcccctgtgtctgcgtcactggctagccgattttaatgatcttccggcgtttagtagctcctccattgcaggtcttcgttatcaaagcgcatgcatgcaagactttaatatgcatggagggctagctctctctctcttgtcaacgcgagactttaataagagtgctccaaatctatctgatgtgtaaaatgtgttaccaccgaggtacgttaggtcacgtcaataacgacaaaactgagagttgtttaaatcacaccccgtttccaaatatcgtcactgttcaatggcttctatggccctccgtccttagcagcccttgcgcatgcgcagccaagaaaattcgtaattgactattgcgtacagctagcacatggtcatgtcctccattatattgcaagtttgggactactcgcaagattctccaacgtagcttctcgcataatgtacgtacgtaccatgttagcattaagg

SEQ ID NO: 5118 - DNA, 2910 bp, Zea mays
  misc_feature (1)..(100): optimal_loci_3282_G1, chr1:17006636..17009545, Cluster 31
gcaaggacatcatcgtggcgctcatcctccgcccgctacccctaagacggccacaacatccgttgtcgcctccaacgaacgtgctttaacttattaatgccttctttgatctattcatggatccgctactgctcggcgccacgacttatagcgcaaagccgtgtaacctcggtgcaaaggatgtcgcccgctgcccttaagacggtcaccacatcgattgtcgccctccatcaaacgtgctttaatttattagtccctcttttgatttattcgtagatccactactgttggacgtacataaagccgtgtaaccttggtgctataggtcactgtgtcaaccctcagggttcaaacacgatattagtgtcaccaaaagatacaaacgtgaagttttaatttaaaaaaagttaaatacaaaagaagttgggttagaggaacactttgcacaggttcagcatgggcctaattaaatcgggcaaataaagttatgggcccagtagttcacgtcttgtacgtattgagcccaacagtattattataccatcgttattcgtctagtctagtagaatagaaaactgtaaaactctaataccatgcatctcccccgccccctttttttcttcctttttgaaacggtgtctgatcagtctccaaagtctagcttgtacaccaagtcagtcgtacatgtcaatgcaagcttacacatacagtatacatgtaatgtacaacgtacgcaccagtaccatggagctagcatgtggcctttgaaactgtacaggcgtggcttgcaaagttgcaaccggcaaaagaataccaatctgttgccttttgcaaaccacatgatctgggcacaacgcccacgcacttctagctagctaggtgcagaccgctgagtcttggtcaaggctcgattggaacctaccaatgacgacgaccaaaccaggcaagcacagcacagcacagcacagagagatatatatgctgctgcgttcttgacggcctgaaactactggatcaaaaattcaaaaccttgtgcgcaacaaaatgcagcaggtagctagctgtttcggtatacacacacggtgttctctagtttcttgccaaaaaagcaacgagaacgcattctaactaacattctcaagagacgaagcacaataaggggtcgtctagactggaacttctgacgacgatgcatctaacgatcggccggtcgcgacttggactactactactggcaaataaaatatgctatattactagctgactagtcgactctccattccgtgtgcatatatatacatttttattttataaatattatttacgcttgtgtcgtttggcgcaaaagttaattgagatgggctaccggccggccggctggcctatatattcgttaactagctactcaccaaaactgccaggaaatgtccaagatatgaacacgacgcgtactgtgtacacacctaattaataatctggtcagcgcgctgcaatccaaccacgtacgtacgtacatatatgttccatttccgcatgcgcgcggcggtccaagaggggtccagtagtgtatgtagacggtctcgaagacttcaaagtgtaatttctaccaacattacattacattcacgcacatcattcgttcaatgttccaacaagggtgaaaaatcacaggctactagctaggctaactgttgctagatagataataataataatagaatattgttacacgcatgcatggatgcattttctagatttctctgtacgtactcgtttagttacctcagcggctcagctgaatatggggtcttgacgaatgacgcgtgtggagacgcgcatgtacaatggagaattcagttagagtggaaagctctctctatttttctttgctgcaggatgggatgaccgatgatgttggtagagacacgtacgcgcctcgcaaaccaaactaaagaagaacacggacactaataatagaaaagaaatgtaggcgaaactggcactaagcttaatggtaattcacttagagaattaaatagtgcaaattaggttctccaataacagttttgttattagttaatgcaacagtagtcaatgcaaaaaaaaagtcatatgcattcagggagtgcataatgcgcatgcaccattagtttataccgaaaccattattgcacacttatgccatacgtagctaggttgctagctgttcattttctgacaaacccaaaagctagagctgtgatctctacgactaaataaacagacgagagcaacttgtttctctctgctctattaatattacgtgtgtgcgtacgtatacgcatctaccgctaactcatctcgatcacttcatgggaagatgggaagcaatgcagttcaagtttcgtggagaacctaagccatggaatccggagtacagtatatatatatatgcatacactatacagaaacaatcattagtttatagtttttctatgctcaaatccctacctaatatctgcagtgcatgcaatctagctagaccaatagaaccggaccatgtgtgtatagtaggacacacagagatgcgcttcgctgcatacgtctctcagccccatgtggccctgcatgtgtgcatatggacacgcagaagtcaaaccttaaaaaaatctcttgaaatcaagtcttttcagaatatacgttcaataatagtgttgctgatcaacctacttaatattctttgcactgttagctatagctactaccagcaaatagaccagtcttaattggtttcttcttcagttcataagcgcgcgcgtacatacagtggacttagatatactctagctagtagaccagcaataatgcatgaccaaatggagtggttataataaatcgatgtcgtccctgcgtaatggtaatccatgaagc

SEQ ID NO: 5119 - DNA, 1637 bp, Zea mays
  misc_feature (1)..(100): optimal_loci_33889_G1, chr1:206874615..206876251, Cluster 31
cagagagattgtagataaccgtagcaatatacggtatctagctagattctactcctgcgagccaaaggaagttactttcctacgattaattaatggattgccaatctttctttgcttaggatcgacttgtaactgctcttctgttctttatctctttttttatttctgaactcccctccctccctgcttagctctttcttgttcctgtactgtctagtgagttgttgcagcttttgtttaattctcagtagcggtttgcccctcatgttttctcaaataaaatgttttcataatggtctaaaaacataaatattatatcatgaatctatatttttcttgaaaaataatggttaaaagtataaatatttgatttacaataaacctaatacgatatgcacataaaaaacggagtatctctttgatcgtggatttttggctatagatatcatcagaacatatatactcctcgcaggtgacctaatttattataactttattcgtaaatcttctggatttgtcctaactcaaaatatagctgtaagaattaatatctagtaactgtatatagattggctggactcgctgcacctattggctattgctgtagcagtagctagctactgccatttgcatcgtaatctgcattaggcggcttgcagcgacagccgcagaaaaggacggccgaacaggcacgacttccataaaaaattaacattgctgtaaccattaccaaaactagttttataaaaaaaaacatataactcttttctttaagatagtactataggagtaacttcgatcgctaaccagatgaaaaaaagattctggacttattacagatataaatttgatttgtattttggatcggaacaagaagtatataaactgaaggtggcgctactactccggaaaagacgacagggaatcggacgcacgggcaggcacacgacagagattctgctccatgtcgatcgtccgtcgtcgtcgactttacgatccaagccaagccaagccctcatgcatgcaataaaaaagaaccccatgtgcattaaaaagactacttcatgttctccccctgtgtgctgctccactcgatcggcagcggcgcgagaaccagaattgcggacgctggtttggtttccacttccgtccgctcacccgcaatcagctagctacaccgaacctgcccccgatgcttgcttgccaaattggagggcaactctcacctcacctctaatctaagctaaagttattggctaaaccgcgtagctaatcctagtttatgcagcggtggttgccgatttcagccgcgctgacgaaccccagccgcggtttctttcttccttcctttccccctttgcgccactggtagccaataacacaggcgttgcctggtgtggtaatggcacgcatgcagctactgcatgctggaacaactgggggattactcaaaacgccactaggttcgaggtgcttggtttatgctaggggcgcatcgcgctgacgacagtgaaagctgaggccaccgctggttcgtcccctgcatgcgctgcaacatgggattttaaaaattgatgggccgagtgatctcgtccgtgcatgtagcccggtaataatcataaaagcacatgtttagt

SEQ ID NO: 5120 - DNA, 2407 bp, Zea mays
  misc_feature (1)..(100): optimal_loci_343273_G1, chr10:112131085..112133491, Cluster 31
tctgccattgactagggtgcatggacatcatcttcttctttggttggggtaacctacaactagatctagggctgctataatggcgtgtgttgtggactctggtgctcatcacccttctaaatctatagcaggaactatgtgtagtggcgctagagcgaactagcacaacttctgcaactatccacaattattacactagtgttgcatgttgatgcatggtcaatgcctagatttaggttgcagaacttgcgactggttagtgcacaagtgcattatgcagatacacactatgggttagtgccaccaccaactatggtattatgatagcatttgagagtgatgctacctaagaggggtgggtggcgggggtgttgaaagatattttgttaagcttggtaacatttgtagatctcgtttcctttctatgagacaatattgtggagagggttcgtgcacatgtttgttaggacctagatggctagatagaacatggtaacatttgtggatctcatttcctttctattaggcactattgtggagatcatttatgcacatgtttgttaggacctaggtgactagatcggaggtgaatagcctataaacaatttcttacaaactcatatttataactagagcaattttaattagtataaaaggtggcgcgaaatcgaatatttgatctatctctactttttaatatacaagcctttctaacaattatagttgctaagtttctagatagatataacacaacttagcaagtactcaaatttactataaaaattgctacaaatatacgcttctctatagatacttaagcaattaagacacgatgcaagaatatgaatgcaaatgtgggtgtgatagcttataaaaccaaactgagcaatagaatgaacataatgatttatcccaaggttcaattacttgcctacaatgccaaccctataataaaggcgtcttaagaacaacactagagagcactccaacaagccactatttcactagacttgctctttgtaaatctctcgtggggaatgagcgcaagagcctctcacaattaattgatgatcgaagcctacgacaatcttcaattgccgctcaacaatcccatgagcttcaagccacctaattgatgacaatcatcaagagtaatagaagtataaccagcccaagtctctctactagcaccacaagatacaagaattgtatgtgatgcaccaggagctctgtagtctcacccaaataatgatatacaatatgtagaactgtatgcgatgcactaggagatctctagtctcactcaaatatttatctaaatatgtaagtgagtagagtgtatttctctaatctcaaaacgtgttcacaagtatttacattgcaaggatgctagccatggctggccaatgggtctatttgtagccccatattgaaatccaaccatcacatcttgatgggatggactcggtggcatcggatgtgcctggtgcaccattcatttctgcatcggattcgtctagtacctttctaatgtctataattccattggctataaactagctgttatcctctatcaggtattcgatgcacacactggacacaaaaccgaatatgtggtgcatgttagatctgagtgcataggttacatgattttgagtgctctatggtgtgatgtctagtgctatactggacacttcatatgagtgttagagcagcgtacaagtttgcaagctttctgaatttcatgttcagtgtgccatcatgtgctgcactaaacatgttcaatgagtcatatctaatgcacaccgaacttcactttgctttgctgaaaatgatgtagcttgtgttatctcgtgttcagttcatatatccggtgcaccacaggacacatctagtgtatgctaaaaacttcatcgagagcactttctcatctcttctcaagcatgctaactcttaaatctataaccaaacacattagatcatagttagtatttttcaaaatgttttcaataaacattttcacttgcttatacgcaatatgcattattttggcacctagtagcaatagatgacctaattgtctaattaagcttccctcttaatagtacacccatctatcctagatcctatcactcactctattgtgtatttaccaacaatataaaatgacatacctatacttttgcctggagtcttttcattttgctttccttcttcctctctgcatgttgagcacttgattattctgtgttcatcaccatcctttctatggttgccattattgtttaatcttgtatatggaactaaccaagcccattgacaacactagagtagaggtaagtcaacttagttgtctcaattaccaaaaccactcatagagctttcaatattgctatggttagtggtt

SEQ ID NO: 5121 - DNA, 1641 bp, Zea mays
  misc_feature (1)..(100): optimal_loci_344271_G1, chr10:116777365..116779005, Cluster 31
cggtgtatgtctacaacttcactaatttgagttttattaccttgttgttcacatggaataataaccaataatgggattgaaacataaaggcatgttttggtaggttttttctacttgccctttcatgatccttttgcacgaggtaaatggtctagcatattcagacaactatgtccgaccacaagtgcttggtggtgggatgctagaatcatggcactaggaggagacgacacaagaagaatttccattatgaaaatatctagcaacatgatccgagtcacatggcactcattcgagatgcattggtatccttttgaggtagagcaaatttgaatgaagtgcaatcaatattaagggaacttgagtctagcctcagagtgtaggatcaaaatgtgtttgttatatctacaaaactgtagtgttcctccatcgagagttagagaggaacacgagcagtctattagtttgaatcctactagaagggagaaccaacttatgttatgcatatccaaacttcttctcaagaggaagtaatggaaaaatagaggttgtgattgaatggtttaaagaaggggatcacaacacattattttgaagccaaacgtcatgagaaatcaaaaactatctctctcaaaaggcagatggaacaatgaatatgactcaagaacaatttgaagatgttgatactactttttataaatatattttcatatcccaatattatttagcgcctgacctaattctagaacatgttctaaaaatgttacgtctaagatgaatgagcggctagtctgcccccacttgactgtaggggtggagcagacaatgtacagttatgggcgcaaacaaggctccatgacgagatggcttaccgctagcttctattagctacattgggatcatttgagcacaagtatcactactggttttttggaatttctgaatgatggtgtagtgctagaggatgtcaacacaccactatcattctaactccaaagatgaggaacccatatgatatggagttttggcctatatctttatgaaattaatgtataaaatttgtatacatgtgaaattgtatttatgtttagagaattcttgtgtttgtggccatctctcatttatacatgaacttgtataatgcaacatgtatgcacttgatattgacttatatgtgcctactgttgaaacttgttattgaatcatattgtatttagaatttatacgttggtatatgctaagtttatttatctcatttgggtatcaatgtgatttatctcaatttttatcgtaatggttgttgggggaaaatgcctttgtcgaaggccaaaacattatgtcactaatggctttcaagtatgttttaggtgcttcagaatgggaatgaggttgaactttgcctgaagtggtgcatgtaccaacacgaagctaggaagctttggcttcatgagattaatgcgtaaacaatagcaaaagaagagagcttcagttccataggcacatggatgaaggtgaataagaagggtctagaagcttgaccaacacgcttgaaaaaggaaggctgatgatgtccttacatgttttatagttcatatgtataggaactgaggacacaattgtaattttgtacgaagttataca

SEQ ID NO: 5122 - DNA, 1532 bp, Zea mays
  misc_feature (1)..(100): optimal_loci_344414_G1, chr10:117723530..117725061, Cluster 31
ctgtatataaatatgtgaaagattagatgaacaaggattcctgaacgacatccaataactacgtctttgattcatagcatattggtgataattaatcatcatattctagttttcatttagcaagagtaattgtgtacacatgtttacacttgctgcagttttgtggaggtacggtagtaggtttacaggtactaatcctttttttaaaaaaaataaaataaaaggaattatatttcagtctctgcgggagttttgttttgcacactagctctcaaaaagtgaaatcgaagaaaaagatgattgactaatctatgtagcgtttcaatttggttactatgagaaagccagtgggagcaccaacgtctcactggattcagatcattctacaaaacaatctacatcgtgttcgtcaccccttgagggccgaaaccaaaccttgcaaggaagaaattcgattttcttggcggtgcaagggagcctccaagttacgctatattcacttatctgaatgtttttctatgtggtcagtcaaaacatcaacttatctgaatgttttgatttattactacatatatatgttacctgcaaaggtttcggggcgatgtgcaagtgtccacataattaaagttatgttttgtttttgttgcagttattcagtcaatcaccatatagtcattaacagaaacttaaccagtgcagaaaaatcacccaatagattttaaaccatctctagtagaagggtccaaaccaacataggtgccacacaagcctccaaggaaaaacttgagtacattgtgatctacctccaggagttagcctggtcccatctggctacctccaggagttagccatagcttaagcttttcctgcatgttcccatgccggctgctctttgagcctcatctctttctttcccagcctcaccaacgtgctgcgccattatgcgaatgtgtatccgaagaactttagattcaccgtcaggtgattatgcaagacaaaaaggaagaggaaggagtgcttaagaatggtaggaatgggaggcatcataaagcaccgtaggctccctcttcaaagtcagagaggagacaaacacgttggctttccatcatgttcccactcccactactcttaggccttctttctttctcttcctgactcgctaagccaacagctactacagaacgttctgagaggcctgagctgttgaacaattcctctgtatatatagtagacgtcgaccagcagagtgtttatagatcgtagaaatgaatgtgtctgttggatagtgtacggtaaacacaagtcaatgacaactggcacatgtgagtatgtgatcctatatatacattattatgtcgatgtaaacactggaggatgccatttttgtggatgaggtcagtttcagtggggatttcatgtcttaattctcaaactattatatgttggagacagtgtgaacaagtttaatttcattcccatgaaactcatttcaactcataaaactttcatcatctctttcttcgtttatatta

SEQ ID NO: 5123 - DNA, 1541 bp, Zea mays
  misc_feature (1)..(100): optimal_loci_347091_G1, chr10:133405487..133407027, Cluster 31
aattacggtagaaaggtcaaaatcgatccacatatccaaacaagccctgaataaatatgtttttttttgcagtaaaagcctggagaaatcagaaacgtagtcggccgggccgacaagtactatgcaatactagcgtgagttttgtttttgttttggagctagtgggggtggtgcattgtttatgcccgggaatttcgctacgaggaacaggaaccggaggttgggttgggttgggttgggtttggacggatcatgagaagtcagtcatggagccctgcggagataaggcgatggatggaaacatgcacgctggacgcgacgcagcgaatccaacacgcaacgaatctacctcagtctactgctgtctgctcctggggcagtcgtttttctttatgcttcctttcgtacccacagttgttcacgtgagccctccggagtccggccccgcggcgtcggcgcggcattgaatcctgtacagcaactgcacggtccatcaaattggaatctttacttttgatttaagcctcatcagttttataagctttaacttttttattgcaatgctataataaaaccctttttttatagacactatcgaactttctctctgcctccctcctttcttttatggtttgccgagctcgctgccccaaccccaacctcgctagctgcctagctctagggtttcaaacggtacttaaatttggttttgaggttccccgttgtaaatacctttagactgacccactagtaaacacctatttcaccgtctataatatcaaaactgtgttttacactacacatctactttattcataccggcgaattcaaagaacttgctatgtactcaacgaaccgcagcctggcagccggcaggagtacggatggtacattttaatatttgatgcgtcgagacagtgtacccgttgaaaaatgaagacgccaattgcagagcccacattagtactcgaaaatatactccctttattctaaaaaacatgaaatatcttaacctttataacaaaaaaccaaaacatgctataactaaaacgaaataagtataattataacatgttaccgagtcaaatcatattatttttttatcaattccataactataatataatacatatattataaataatatcattacattctttttatcaaattgggtttgatatattatatctatttgaggtcataaatgttggtctaaaagaagataaatctaagattatatcttttcaggaccgaaaaaaaacctatttgcatcattgcccccctagttttaagaatagaaccaagtgcatgctatatgtgtacccatagatcaaccacaaacatatagagacaaattatagaggatataattcatagaattttattacatcacgattatttttcattacaagaataccaaaagtattagggggaacatgaaagattactagctctccagtgaacatccaccatactccacacggaacattgtctagttgacgcaagattaaaagcatcacaatctgttacccatccgagtt

SEQ ID NO: 5124 - DNA, 1669 bp, Zea mays
  misc_feature (1)..(100): optimal_loci_347485_G1, chr10:135335487..135337155, Cluster 31
gtggtcagtgagaaaccattcaaacctaacacgacacgaagccaaatacaatacaaaactaatacgacacgatgccgcacacaacacaacactcgtataaagtaccaccctgctagttagacgaccaacagactgaacgaagctatataaaagagggtctggctccttttatttgttcttgtgtggggtggcaacgtaattccttgcttcgccagctgacgaacaaccttgcaaacaaaaaagacaaggaataagtgcatatattgactgactctagctagtctgtgtgcgttcgttgcgtcaacaagcagcatgtatattatagtacacgtataagatcgcagtaacgccaataatgctgcagctgcatgacactgacacccccacgatcgaccaacagggaagctacgacacattcgcattagccaacgaaagtacaatttgtttgacaagactccaattgactaaccgagtaatcgaccttctcgcatagcatatactgcgggtacgcctcggctacttgcgcggcacgaaaggagaagttcatggcagaattctttttcttcttcttctcgttgtatatagcaacatggttcgaccccggccgattgcgttgcgtggctgccaaggtacacgtatacatacactgatacacacattcgcattccttctggggtcataagaaaaagagtctagctatcataaatgttgacctttgctatgataatgtgatataatttcgtgagttattatgcattttgtcatgttttaattatatatttttaatacaattatatactgaacaagttcacgttgtttcggacatgtgcagcagataataacgtacagataaataaatgagatgtcataaagagaccttagaacgtactgaaaaatagtataatgtgactctctcctctcaaccacacaaaaaaaaacaagtgtttacagcactacgctacttttgtctcataataagaactagtgacggccttgactgacttagctgttcaagtcttacattgtgaggtatggccactggcgataaggaatttttgtagaaaaaaatgacggggcagcctcgctcgctgatgaacggtcaagttgaaaatgacgagtcatcgctcgatccgctttaggacaaggcattaagtagaaatgcagctacatatatctaccgtttgcaagtatttcgtttagtttcgttccaagtgcaatctccttacgtggcgacgacggacatctcttcctccttgctcatcgccaccgttgtgctgcgctccagcgaaggtacttcctcctcttcgtcaattcacggttgcacgctatcttcaagcggcgggccactccgacgccgcgaagcacgtgacactccgacgtcttcctcatctctcttgctagctgccaaaacttgccaacgcttccttccaggtaggattagtattgcgtttcatttttttttctctaattggtgtcacacgtcgtatctctcagttcgagctaggattaatattgtgtttcatttttccccactggtagtctggtgcctgcgttgcttatttgaagttcttgacgaggtcaatctggctatgccaatcgaaggtcaccctaaatccacgcgcaaacgtagtaacatcatctttttttcttcctcctcacctctacgctc

SEQ ID NO: 5125 - DNA, 1623 bp, Zea mays
  misc_feature (1)..(100): optimal_loci_347526_G1, chr10:135621975..135623597, Cluster 31
ttagttggtatcacgtagacaagttttagaacagatcaaatccaccaaaagtcatataaatatatagtgggtctgtgcatttgtccgatcgacaatgctatagtcaattctcaaactgatattttacgttggggtcattggtatcctcaagagcttgagaaaattaaatataatgacgtaatcactagctagtggcatagatatatttgattcagattaattactaacttggaagaagcaacggtggatttttaatttgtttcatcaggtattgaggacgagactcgttgttttttagttttgctgttagatatattgaagttttaacccatgcgtgcgtgctacaacaatcagttgttgtactttttgttgtactgctgcacaaagatgtatatgttactccgtacttcttttctttgaaagacgaccagaccaacacatgcagattatatggtacgtatcattttctcaactgtcactgtccgttacagtaacatcactttcctctttcacgtcttcactcctcatgccctccaacatcaacacagtaagctgtgccggactaatcagctctcgacaagtacccaaacccatgcagccgagacagcagtgcccgctccgaaagcaaaccggtactacagccgagacggctcgtcccacgtgcccggtcacgtgcggtgaagtgcggccagcgccagcgtcagccccagcccccaggcgcaggcggtgagccggtgactcggcgtggctgtcggccatggccgggcacgtcaggagctcgcctttctcgggaatgggctgcgctttgcccgtgagacgagacccatgccatgacgacgcgaatccttctgcaagtgggcccacgctgcatgcgctgcacatcgccaaagggaaccctaaccctagggatgctccaaaattattgatgggaaaacgaaattattaattgcagatcatgcctccaccactttggtatttctctccctctatccaaaaaataaatcaactcacgagaataagattaagtcaacctatattaaaattcaatcatttttatagtaagatatagcaatatttatgataccaaataagtagattataaatatgtattcatggtactactaattacacattaacatatggatgttcttttctatacattaagttttttaaaaaatgacttaagacaattttagaagttaatttatttttgtattaaaagagtattcatattgcggtctagcagtaatcatatcctagaatcaccctaaagaacatcttaaatttaggggcaagtctttctatccctaaatctagtgtgttttgactcttttctctatttttttatactttaaactatgaactaaacacaaaattaatatgtgagtaccattttagactacgataaatacatatgggaaaaactaatttacaatttattaggaatatggtgtattgtctatagagggatggacttagaggtaactagtatgtaaactaggatttaggagggtggaatcttttagaggatggtgaaaagtaagatttaaacggatgacatagagggaaccattgcaaatagtcttacaggagcaagagcaaaaggacgatgggaacaatcag

SEQ ID NO: 5126 - DNA, 1574 bp, Zea mays
  misc_feature (1)..(100): optimal_loci_34764_G1, chr1:211422531..211424104, Cluster 31
gtcttgagtacactgtaaacttccatctatggtgtgggtacatatacaagattctatctgtaggcatgagtgctagtattgcctttcctccattagtgctagaaatacaaagaatttcacctattctagtaataattcaaatcgcatgtgcgagtaccgatggatatatcatacgcaatgcatccagagtacaatatcttaaccatggtataggtacatgtataaaattttatccaatagacaatttgccattgacggatatttactctagtcgtttcttacccgaacttcttccatccctacacttattttagatgtatttttgttctaagctaaaaactcataaattagatgttttgctagaaagaatcttaataagttatttcgatctctcaatatagcatatctaatgatggatctttgttgagatttgttttattatagttgttttcactagttgatgaacaactaaagaatctccctaaagaataaatggtacacttcacttctcaatttgataaagctttgcagaatgtgagaacaacaaaaaaagtgggagcctcagagatgttttaaatgtgactctcttaatcataattttcctaagtgcccaaactttctagtaggatatataagggatgcatataaagaggagagcaaaattgaaacaagtggtaagaagaagcacatttttaggagcaacaagaagaaggaacactcgaattgcaaggtggtgtattgtgttctttctattcttgattcacaaggaaagaaagagcttaggaaatgtctaatcttagacacacacaatttttttattgaggttgtgatacctttcattgtgcaaagggagatgcaaacacatttcggtgatagaaacacaactagtgcaaaatatgaatcttccataagaataattgtgttatgcctacttgtactttcaattatgtgttttagtattggactttaaaatgtttcatagtaaccccaataccaaggcctcgataccttctagtgctatgtaggtttttgaaagcaaaaggagaatggagaacttaagatttatggatcttggtctttttctttatgcgattgttgaagtaaaaatgtcatacttatacatgttcaaaataccaccaacatgcctcaaaataaaataaaatgagcatgcatgaggatattttattcaaataacaaagttcacttgtacatggagtttttctatgtaggaagtgaaatgaagtaaagtatgtccaaggggaaaaaccctaggatcgatcgacccttgggggatttagtcgacatgctaacaccccctaagctctcaatctaggtaacaatcctccaaacagacttatggatagtcccaaccattagacaaagtttgtgctttctcttaatgatggaagataaagtcacatggattggaggcccataaagtagagaactgatgtgacaacatggccccatctacatatacctctcaatgaacatgtcaagaggtccaacaccaaaggggagagccctcacatgtcatatgattgaccaaccatcccctatgctcaactaccttg

SEQ ID NO: 5127 - DNA, 1424 bp, Zea mays
  misc_feature (1)..(100): optimal_loci_348686_G1, chr10:141534551..141535974, Cluster 31
cctaatagtacttcgttgaatgttgcattggctatgtaccgaaaagtttaacagtactttgttgagcgttgcattggctatgtaccgaatagtcagtctggtcttcttcttcttttaacattctcaataggctgtcttcaacagatcgtgtttacaatcgtacgaaacactattttaaatttgaaatagaaaattagataggaaatatgatggataaactgttggagacaacattacaaactaaaatcaaaggtctgttgggatgcgagtttacaaacaaagaagaaccagcagctaccgaaacaacataggtaccagtaaaaaccagcttgccaaaccatggtcaccctaggaaacatctgttagataactccttccaccttcataatcctggatagttccacgttctgctctgcaaactgtccgtgtcacgtttaatttccgtccatagattaaatgtctcgatcggcaaggccggctaccaaacaaagataattcagaggcacgtacggtgctgtacccgccagcagggatcatcgtgatgccaatgaggaatccacatgacctgcatgctgtcgaccaggagaaaccctctgttcaaactccaactggttattgtgtctatcatagtttacagagtatagtactcgaacagcatgctaatggtattagttagatctggatgtattcatttatggcatccacgcatgtctcgtggctgatatggttaagagagtgctagagtaatcagatatatgcaaattattatgcttgagagtcgccatatatgacactcctatatatgttagtattggaaaaaaaacagaaactttgtagggatgaccaggtcagaatgaatactactgatgtatgtagcaacattatgaagtggaaagtacttccacttgcgcttgaccagcgataacagttgggtttagcgacgatagatagatgctctggttagtgccgatctcaccggagcgtatatagcttaagtctgtcatcacgtgcctcaccacaaattgcgagtaatttatgacaaaaaaaacagcccggaaatggagccaaatgtggctgcacattgtattgcttaattggtttggttgccggtcatcatcacagactgaaaacacatggccaagatgtacctgcattgtttaggtgctgatgtatgtttgctaaaaagatgaccggcttcgatttagtgttgattaacattatcatgaattatgaattgtggtgtgtgcaacatatgtttgatgattactttgctagtttgcttgaaaactggtcgttcttcgtcacataagtgtgattattatcagtattctttagtggtttgctcgtaattttttttgttcttcgctatgtaagtatgatatctttctgttttctcatccgtggcgatccgattaattagcttt

SEQ ID NO: 5128 - DNA, 1459 bp, Zea mays
  misc_feature (1)..(100): optimal_loci_349362_G1, chr10:145011025..145012483, Cluster 31
  modified_base (1123)..(1123): a, c, g, or t
  misc_feature (1123)..(1222): n is a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
  modified_base (1154)..(1154): a, c, g, or t
  modified_base (1155)..(1155): a, c, g, or t
  modified_base (1156)..(1156): a, c, g, or t
  modified_base (1157)..(1157): a, c, g, or t
  modified_base (1158)..(1158): a, c, g, or t
  modified_base (1159)..(1159): a, c, g, or t
  modified_base (1160)..(1160): a, c, g, or t
  modified_base (1161)..(1161): a, c, g, or t
  modified_base (1162)..(1162): a, c, g, or t
  modified_base (1163)..(1163): a, c, g, or t
  modified_base (1164)..(1164): a, c, g, or t
  modified_base (1165)..(1165): a, c, g, or t
  modified_base (1166)..(1166): a, c, g, or t
  modified_base (1167)..(1167): a, c, g, or t
  modified_base (1168)..(1168): a, c, g, or t
  modified_base (1169)..(1169): a, c, g, or t
  modified_base (1170)..(1170): a, c, g, or t
  modified_base (1171)..(1171): a, c, g, or t
  modified_base (1172)..(1172): a, c, g, or t
  modified_base (1173)..(1173): a, c, g, or t
  modified_base (1174)..(1174): a, c, g, or t
  modified_base (1175)..(1175): a, c, g, or t
  modified_base (1176)..(1176): a, c, g, or t
  modified_base (1177)..(1177): a, c, g, or t
  modified_base (1178)..(1178): a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
  modified_base (1196)..(1196): a, c, g, or t
  modified_base (1197)..(1197): a, c, g, or t
  modified_base (1198)..(1198): a, c, g, or t
  modified_base (1199)..(1199): a, c, g, or t
  modified_base (1200)..(1200): a, c, g, or t
  modified_base (1201)..(1201): a, c, g, or t
  modified_base (1202)..(1202): a, c, g, or t
  modified_base (1203)..(1203): a, c, g, or t
  modified_base (1204)..(1204): a, c, g, or t
  modified_base (1205)..(1205): a, c, g, or t
  modified_base (1206)..(1206): a, c, g, or t
  modified_base (1207)..(1207): a, c, g, or t
  modified_base (1208)..(1208): a, c, g, or t
  modified_base (1209)..(1209): a, c, g, or t
  modified_base (1210)..(1210): a, c, g, or t
  modified_base (1211)..(1211): a, c, g, or t
  modified_base (1212)..(1212): a, c, g, or t
  modified_base (1213)..(1213): a, c, g, or t
  modified_base (1214)..(1214): a, c, g, or t
  modified_base (1215)..(1215): a, c, g, or t
  modified_base (1216)..(1216): a, c, g, or t
  modified_base (1217)..(1217): a, c, g, or t
  modified_base (1218)..(1218): a, c, g, or t
  modified_base (1219)..(1219): a, c, g, or t
  modified_base (1220)..(1220): a, c, g, or t
  modified_base (1221)..(1221): a, c, g, or t
  modified_base (1222)..(1222): a, c, g, or t
aatgcaccacatgttcccattggtcatcgcagctcaggggattagtcatgctgtacatagatttagaccgacttcttttgcttttttaatattttaatgatactgtatgggcactacatcttgagtattacaatgaacaaacaacagttatgcgctccactccatttgcaaagaagataaatccgtagcttagaaaacatatctcgttcctcgttaaacaaatcttttggaattaaaaacagatttggctattgtaaaacatagaatctttgctcgtagagttggtgttaattgtgagacagcgatgacacccatgtgatgtacagcagcaatcagcacattgcatactacacatcattttacagcgccagaacggttgatgattttgtatcaacgttggttggttttttttatcgagtgtcatgttttgtccctgacgacgaggcgagtgttgcaggctccgtcaccagtaagcgcatgaaggaatcctatttttatcaactcgtaacgacattacgccaactatgcattcccatggtcatgctcgaaatattcaagcatcgtccttctggctggagctggatgcatggtgtgcaagtgatgacctggccaccttcttccctgccctcttcattcacgcccgtgtacaagacatcagcgtccacgaactcatcgggcagggactgccctcgtcgttccatccaaggacacctctccccctcattgtaaaacttgctgtctgggatcctactcaccgacgcccctgatgtgcgacactgctcggctgcagaccacgctggacgtctccaaatgaaaacaatctactcatgatcgtgtaaggggttctgctggtatccgagaaaaaattattggtcaaccaaaaaaatattattctctataatcatagtaaatcataaaactgttgtgtcttaaaacgcaggtcataacatcaaactagtaaacttgtgcagactcatggttttagtacaattttatcttataccgggtacatgctctaactccaaccctttgacacaatatcctcattatcattgctattttcggagaagaaaacctcttccttttttcaactaccaacctgaaactttcgggtctgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacaaattatcatataaaaaaacataataaaactcaatcccttgacacaatatctcaatatcatgcaacttcgagaagtagaagtctcttcatttttcaatagtaccaactgaaactttcaggtctgcaatatacaattcaacaaataaagcagacatcaagtacccgctttatgaattcaatatcactacctcacaactatgagtaacgaatcaagcttgatttatcaagaa

SEQ ID NO: 5129 - DNA, 1461 bp, Zea mays
  misc_feature (1)..(100): optimal_loci_35693_G1, chr1:215897305..215898765, Cluster 31
ggtagtgaatgatacgtactgtcgggttctttaaacaaactaaaggtcctaaaatatacgggccaaattacaactcattcaatgctgatgatgcgacgcttcttgaccttgacccaggttggatgtttgaagtcggtgtagcaatgtcaatcagaagataagcgacaaacacgcgtttaatattgacatccggcccctatatatatatatatatgtccacatcagcactgcccacaataaacatcagccacatatcagattgatgtggtattggttatatgaacctcagagatattttgtaattgcagttagcctcaccctctgccgcctcagcctgatgtggtattgttttgagcatgcgaaatcaaatatactgatatatacaggaagaaattttggaaaccatcgaagaaatgtcctacttctctcatgtattttttacgctactccaacgaaggtttggaaaccatcgactgatgatacaggatgaaattttggatcataattaattctcagtactggttaagttactgatgcaagcatgcatgatcagtaacatactgctattagtattaaaaatagtattaatatcagttgaggactccaaccgatgataccaacgcctgaaatcagaagttaacgcaaagttttttttagcgaagcgcaatgcccagatctctcgctcgctcggtggacaccatcgtatcgatattgacctatgaaagcatgcatgctctcggtgacatgcgcagttagctaccggaggagtacaactacgtgtcacaagctcactgttccatcaatcatggcatgcaatcagcttcaagccccaccgtcagatcgtgggcacgatgaacgaacatggacggggaccctccgacctccatgtgtgtgtcatggttgccatgtagctttcggtgcgagctgaaatggcagcgacctagctgggacgacacgtgtggctccgctgatgtcgtcaagcacatatatacctctagctactaatgcatagtatgccccacccaatacccatggtcctaggaaggaggtgacactgacagtgatggcgcagccaatcgcagggttacacacggtgcatgggccatgcactggtagtactacgtatggtttgctctaggggggtccccttatatgttaggtctattatgaacactagtgcttgttcatcgaagggaacagtatggaccggcggcacgatcgatcacactcccggcatttggttctagaggcttccattgcgataaaggtagctttgcaacaaactttcagaacctgtacgtcagaaccagtacagcacgtacaagaaaggatcgatctcgtattaggtgagctgtcactggtatgtagtagacaagattttactgttggttcaaaactgcttgttttttacttgaaaatttaaaagtaattagagtccttaaaaaccagcggccaaggtat

SEQ ID NO: 5130 - DNA, 2077 bp, Zea mays
  misc_feature (1)..(100): optimal_loci_38329_G1, chr1:229692052..229694128, Cluster 31
ctaattggttgtttcatgtgacactaagtttaaaagaaatttcaataatttctaacaaaaagataagggatgtaggagattaagcatccagaataccttgtatttgatataaattttaaactctagatcccttaattctagaatagagatagtaaccagaggcattctaccatgtctatcctcactaaaagcatcaacaaaaaatggtatattctagaaaacaacactacaaaaaccataactaatcacaattgagagaatagttgttggatacaaaatatttgttaatttatcatgttggcaactataaaaataatgtgtcttgctttaaattacccaaatttggcattgtaaaaatatataatccaaaatatcctaccatctatcattaaattagccatataacaaagtattatgagtagattaaagtgatcacattgctatataggaagaggagggtgtgtgctttgattagagccacttaatactatagccaactttgaacatataaaatcatacataataactcaaataccatctagatatgaaaatagatttttgtatgtgtatctctagtacaaaaaatgcaccctattatataatcctagaaactaggtatgtagtctaggaaagtaaagacactcaaatggagtgcataagtaaataaaaaaatgtaaataaggatatataatggaaaatcaacaaggtgaatttttacaaagatatcggaaagtttgtgctttccaataatctttgttggaatctctcgcaagggctaatcttacaattaaactgtcacaaaatggaatatccttgagggtcgaaagctcttaagaaaaccatgcaaattgtcaagaaaactacttttgctggacaatcctcatggaagaaccaccgatagttgagagagaaaattttgattaccttggggtcaccttaaaccaacagtaatgaccatggccatcaacgttgataaatgatcacataggtccaaaactggtggtcgtaggagctccaaaccaacaatgatgatgtttctatagtagtgaattactccccatgaatttgaattaccttgatgatttttaataacactaaaggaaatttaaaaataccttggttgttttgaataaaacccaagaaaataagaaataacttagtagtttgtaatgacattcaaggagacatggaattaccttagtggtttggactagcaatcaagagaatatgaaattaccttggctatttgggttagcactaaataatatgcaattaattggaggttccattcaatcaccaaggtaatgatacatccttgggggtttaatttcacccataaaggaaattgttgaccatcaaaaatattacattttcttgtagtatttggcaaatccatggctggttagagagttttccccacatgatagcatgggccttttccttgcatatccctaagtgctattttttgtcatcacttgatagagctttggccaaaaccctaagatcctctcctcctacggacaataccaatgatcacttcacattcgtggttggacaatcttgcaagacctataaggccgttacgacaaatcttagtttgtgcaaacacaaacataaaaagaggtgttcaaacctcttctaaatgtaagctaacaactaaagcaatgtgctaagcatcctaaactactggcaatcaaactctaagcatgagctagtagtggtagtattaatcttcaaaagcactccttggatagtgaagctctcaaatataatctatgtacactttaggtagcatcgacaaccaaataatggtcagtcaaagtagggtatagatatgccaactaagcaactcaactagctattgcaaccatcaataacattttctacaattattggttgataaccatgccacaacatggccttgtgaattttgccactaaataaatatgcatcactaatgcattgtgccactaaactagccgttaataaacatgacacaacatggcctagtgaattttggaatgtttgtgcctcctgtgcatcatgttgcacatctctgtttttgctagattgtgat

SEQ ID NO: 5131 - DNA, 1701 bp, Zea mays
  misc_feature (1)..(100): optimal_loci_38820_G1, chr1:232342175..232343875, Cluster 31
cgatctgatatatttagttttgtatttttagcgcaaggcaaagtcaaattattatgtataacataaaaatagaagtggaattagtataagtcaacatgtcgcaagtcataagtcatgcaaataaacacacaaaaaacgtgaaatacttgcgcgttgctttagtcttttttcttctcttccactttcgacgtgagaatacaatatttaacatttttaggacggagagcttcgtttgaataattgtagcttaggttttccagtttcgctataaacacaactctagcaaattgttaaggttctaagaacgtttggtttgcatataaactacagcttctataatactaccgatttatgcacgtgagtttccttgtcctttatatttcgtgcgagcgaatcgaagtggcatgttatgtaactagtggtatgatagataatttttgtgcaacttcgtggggatgcatcttatgagtagcttaaaattttcataaaactaacctctcgtttaacttttttaaaaaagttagagctcgtgaaggtagacctgtttaaatagaagaagctagaatgaacataaaactattgaacttaaaccctcctaaacagcccttactctcatcattcatacatgtacatgtacctttaagatttatttgtataatttattattaagtccaataaactttaacacgtggtgtctgatcaatacctatattcaacgactcgtttcggagaaaacagcatccaattcggacacacgcattccagcagtcaggtgggaggaatcaatgcaagcctgtgactgatgcctgatggctcactgccacagccccgtccccgacgctactagcagcatcggcgtcgctggatgcagcgatcagcgccgctgtcgatcgtctttcttctcctcccgggcggggcggggcggctggccgatggccgcttgcaacgaccagctagcgttgctgttactacgtccgcggcagcagcggtcgctctgagaagagttgcatgcacctgtcggagttgaggaacgacgacgctctcgcgacgggaacctaattggcggcgggtcgacaagatctgctgtctgcttttcagccaagcaaaaaaggccactccatctagaaagccaagcaggagttgcgcgattcccagagcgaacgaaaacggatgcagattcatactaacttcattcactgtgaacttcctgctacagcagcggcagtacacagtttgctattgggtcagatggagatggctttggtttttaacgtacacatagaagaagaagaaaaaatgagctgcaaactctttagctgaacaacgttgtcatcaataattatcgctaacacaatcctgaaaagaaaacccatctcctccaaaattgactcccgaaagctcgtgtcgtcaatcatatatagcaagcacgcggtcggtacgtcggcaacgctcatctgtggtggctgcaactgcaactttggccaatcaaccgaccgagcgctctttgtatccgtcttccgaacacgacgacatgtgaaagacaacgacgaaattcattaaaatacaaaacgcggtatgtaattggcctcgtctaaaatttcattcaaaattcaagaccaattagtgagttcatttcacccttgtgcctaagaaagtgtttgtacctaatgatcaaaagtcttgcgtcataagacaattcta

SEQ ID NO: 5132 - DNA, 2164 bp, Zea mays
  misc_feature (1)..(100): optimal_loci_39389_G1, chr1:235188648..235190811, Cluster 31
ggcccacgatgcattgaactcaaaattgatgtcagcccaacaataacttcatcacaaatataagaatacatgtacaaaaattgaagtttctggcatgcatgatctagttccagcacataattgattgtcatgggtacaataggtgcagcatacaatgaacgaataactcttgaagaaaatgtaaatatatatccaagctataagccaacagcccaacacagacctgaaaagttttcccaaggcccatgttatgcgccaaaatgcacccaagacctttatccctggatttgacctttttaacagattgaataacattttcccacataaaccttattccttcaacctgtgatatcataaactccagtcagactcagatatgggttctctgtactgatattaattgctgttgcaagagtaacagcatagcctttgcaaacagttaaatccccacattaagtcagcatgtgttcaggattaattatgaacatgaataagagagatcttaaccaggcagacctgatgaggcttcagtttagaagacatgctgcttggaatcctaacaggttcctcatcctcctccctggcaaggttgactacatgtccatccccagcatcctgtaaacagatttccagtggagtttcaaagggatttccaacattcttgctccttaacttggtggcagattgctcttgcattgacttcaaatggtcttgccttgcctacaaaataatgtaacagcctagataagacagcttcaaacaacactatacatcaaataaagacacaagactgaaagatcacaaaccttctccattgcaattttacgctttgtttcttcaccaagttctgtatcatccataattcttctaatactcttcttcattttttgcttgctgataacatgttcaaggaatgaccaggagctaactttggcatgctaaatgaattaggggaaaagatcatacctaacaggaccattattctctgatccagaaagctctgcattgctagtctctgaatcggaagattccacaccactgagggccttgtcacattcagaaattaagagctctagttgactgggtacacagcagcaacactgccaaccagtggctttagcttctgataagcattcttcacctaaattccttgacaagcaatttgtacagaaaagaagcttacaagaactacaactttgaatcagttcactttgtgcacaccaagtgcaataactaccagatacaggatcctgcccaaatgtgaacagcatcaagaaattattaatgcccagttcatgacatcaatagtcagacctaatcttgtataaagttcaaatgtatctactattatacttaaggaggtaagcattcacctcaaggcgattcttctctatcacaagaaatctgcatgatccacaaacaacaacatccaagacagggtggcgatgcacatcagaggcattcagcatttcagagcaaatagtacatttgaaagttttatgcaaacttttattagggagcttagggcttgggaagagatcaagatcaatgatatcaaccactttttcaaattctgttgaactaccttcaccatccttttgtaaagcttgtttgctatctatctgcatatcatcatcgctttcaactatcacagttttcaatctcttctcattatcatcatcttcacatgtatgcttcatatctcaatagaaactttgttttcatcagttttgagttttttagatgaaggacagtcacttttagcacctaaaacgccattttctggtagaggaggcttctcgtcacatgatgagaccaaaccaaagttctcctggaaacaggaaaggctggattaaatgaaagcaattcacccaataaatcaaagaccaatcaataatgcatatttataacaaatttagttgacaaaaaaacagagtttgaaaccatttaactttaagtaattaccttacaccagtctctcatcctttttcctttcaaacggcgctgcaggcacttcattatttttgcgtcatcctcttcccttacctatattaagggtagaatttagtttacgattaaaggaactgcacaaaggaatcccctatcaagaaaagcttatcttttgctactaggaagtatgaacccaacagctaaacagaagcag

SEQ ID NO: 5133 - DNA, 1460 bp, Zea mays
  misc_feature (1)..(100): optimal_loci_40026_G1, chr1:238519661..238521120, Cluster 31
tgcgctttcatccttgtttggtgtaaaagggttaacctaatgatgctagtatagactcgagaaggtttatatattggtctacacttactttgctcagtaatagcagtgttagctttgcactctaatttgaaaagggatggagatttgggaacaaattgaacaataaaatattttttgatatcttagtccaatatcttatgtgttgatgcatccatacatctacttaccctatttcctatgctggcctactgtatttggatctttccctctaccactaggaggattttgggcaaatggaattattagcctttaatagcgcaaattgagatgccaccacctccttacattgtctctctagtctcttactttgttaggtcgccttcaccttctgctcaactattttttttatttcccacacagtgttgctcgacatcgccatcatggtcgctaggatttggatcaagacattagagagggaatgaattgggcctttgtaggcatgctacaacataggggtgcaaaagttggacccttatatcaagaaattgagagcaaaactatcattacctagtgtatcctagcaactctattttagaaacttaacaaaatgtaacaaacatagcacgctaagcgaacaaagctttggagcaatgtcacaaaagagaagctgagattttagtggcgtgtaagctaggaagccatggcatataaagaatatgctcatggggaaaaaaagtggccaatacgagacgaatattgtgtcatgaccgagctgatttcttcaacactttccaacagtctcctaaaccataaacattagagttttgactgctccagcctctggcgggcctagtagctcctcctatccctattattgtttgtgatctccaagaaggcaagaactcccttcacgccttcactaactagagaggatcgtccacctctttgaatacaacaggcaaccaagtgaataaaccgccctttcctaagagactaatcttgcacatgctgccgttggtcacccctgcgcacaactgcctccagccagagtataatgacattttgttggcacgaggagcatggagtgggagaagatgagggcattgccatgtccatggcggtagtgcagaccggcgatatttcggtcgagggtgccagatctgtatgttgagaagggttaaaagcgcaaaattaaacaaatagatcgtagaactaaacaaatagattgatgtccactcgaggtgctcttaggaacgcaggggactctgctccctctagttctacatttatttttatcattgtggtcttgtggacaaggacaatattgatgtcaaaatgttagaattttgataataaatatcttttaaaaaatattgaatttaaaatgactttatttggtactgtgtcagaatttgttcggatggctgagagtgacgttagaaattaattaatttagtcct

SEQ ID NO: 5134 - DNA, 1463 bp, Zea mays
  misc_feature (1)..(100): optimal_loci_4065_G1, chr1:21012801..21014263, Cluster 31
ccaacgaaccttagtacaaagaggtcaaacaaattataaattaggatggaggtagattttttatcactattttgatagtttagaaattatattcataacttaacactagaaatattacggaaatataatgatgaaaaattaataatacctttttctaagacacaatctttgcatagtgaaataaattataaaaagtaaggtgtaaatagacctaacatgaacaattagagggagcaaattgaaccacatgttagtttaggattatcaggatatataccaaactcaatgggagtattttgtactttttaatattcttattgttttcgtatctattttcttcatgggacactatcaatggctagtactcccatcactctagattataaatcactctagattttattgctatacagattttgctacgattctagacgtacgtaacaaaattgatataaaaaaatcaaagcaactcataaattacaaccgagggagtataacatttgttttaaataatagcaataataatggtattttacgagtacatagtgcattataagtaagtacataatttttatatttgttttaaatattaaatattttgttacactaaacgtagaacaatagtccccctgaaccaggaacattgtaattctcaataaaaaatggtatgaaatcacaagtaattgtttttcatgctccaacaaaagctaataaagagtacacgcttcattatctcatgaaaaaattgaacaaactgactgaaggcctagcgcccacactctgaacaaaccgaaagcaactaactctcaagacacggtgatggcatggagttacagtttgtaaacaaataaacaatcccaataaacccaaaccttcaaaccacccaatcatctgttcatagggttgtccttttacagttttactagggagtaacgaagcatatttcatgcttctttgctctatgccggtcgaccgttccgcttaagaagaactagaatcagctaaagagatcgaaaatgtccacgctttagtaatccttgtcgtttggatattttggaaagaaacaaacaagcagagttttatgggcatgagcaaacgttgcaactatcactttagactaggatatgcaagaaaccatttgtcaacacaaatatacaatctcaggcattggtattctagttttttttttcattataatggtaccattgataccttagttttcatacatgcataactatatggcggctctgcaaacctcaaggcaatgtgtgtttccttctttaaagcgttaatcgtgaactcttaaccacactgcatcgcaacctgcctcaagcaagttttttgcacaccgtttgaacaccatggatggcgttgtcattattgctattgaaaatgtagggcggcctcagaagacaactggctttgtgaggtatgtatgtaataaacatatatagaaacacagt

SEQ ID NO: 5135 - DNA, 1457 bp, Zea mays
  misc_feature (1)..(100): optimal_loci_43222_G1, chr1:254524911..254526367, Cluster 31
cattaaggtaaagaaaccaattcaatttttactaaggtttcataggcaaataaggccaatttgcaaccctgttcaaaacccaaaccggtgtggtggaagaaggtggtgcaacttatgtgtttccatctttgggattggtcaatgcacctgaataatgaacaaggcagaaaagttttgttttaaggacttctaactttgatccctcgccaaaaggtaaatcagtagttatctcatatttccttttgaattgcatttgcattcagcatttttatttcgattttttcttgtttaattttcaaccacaaattaactctttcataaatataatattgagagaagttcttcaaaaaaatctaatatttttgggacaatgtgggcaccggaccccccatcccatctgccaaccactatgttgattctaacctatgttttcagctaagggattgagtggggaggtaaaaggtagcaattggaggcaaagtaaggggtcctctaacccttatattgtcaaatctagcatgtgcattgtcttcttttacctatccagtactgccatgcactactcaaatgaagaagaagataattaggggttggtcgacccccctactattgcctatcccatcttattttccctaaattttggtacataacatccaatggttcatgaaccaataaattgcagtagaagaggcaatggagggttaggtgaccccgtatggtgcacccatcacccccttcctctattatataaacaaaactagtagaagatcaaatgcatacatgagttaataagaaaatcattaacttcaatctccatttctatcccaagttcttgtcaaaaattgatctctagtttagttctttggttagtcgcaaaggaaattcaaaaaagtagttgttcttctcatgcattattaagcttgtattggctcccaagtactccccaaataatatttgtggtgatccttaaactcaaaagaatgatttatggagtgtcactatccataagaatggtgtgtggaggtgaccacaccccacaagaacgataaactttgcactaactactaatcaataatgttacttttgatgtgcaagtttcattcttgtcctttttcttttgtaggatgaagaacctatttaagaagatggttaaaaagatgaaggatgctataggaggaagctcatctaggtgctctcattgttctgatgatggctcataagggtgggtgacatctcatgacaccatgccttgccaatcaggatcctgagaggaacataaggaagcctatgtttgtccctttagggaaactgaggaaataccaagtgacgaagaaggctttaagggacaataatatggtgggtatgcacccatgtcaccaagtgttgaacaacactatggtgagtacaagaaaacaccaccaagtgaagaccaaggtgcatactatgcacctccgaca

SEQ ID NO: 5136 - DNA, 1754 bp, Zea mays
  misc_feature (1)..(100): optimal_loci_46475_G1, chr1:272054111..272055864, Cluster 31
attttatgatatacttgctcataagggatatttagtgtttgatcctaatctaacaatttgtgcatcttagattactttctactggtgagttaggatttacatcatcttagaaacctaacaaatttactcgatctattttttactaggtcaattttggactgtgcagttcatgttcgtggcagtgccgctctaagaccgatagtgccagaccatcacactatgtagttcatgtttgtggcttgtgttgctaatcagttttagagtgtcattttttacatgcctatccatcccactctaggcatagtagatccttgcaactggcttttagggggcccaatagtctaccatgtgtgttgatattggggagcacttagggtatatggacacataggctcaaggtccttagcaatgcaaggtccctaaaaggttatttttcagcccctgagcataggatcatgggtgagttctcgagcccctgcgagtatgaacaccacaaaatatgccacaatgtcccctaggcgatatagttcacgatgcatctggggactttagcatcacaaaggccccaaagggatgtcccattgaccccaagaccagaggattgagccaacaatgtgttttgggctcttagtatcgcaaggaacccaatgggacatcttcgacccctaggtacgaagagccctatgaccacgagacacaacacttacagattgctcgaatttctcctgcatgaatttataagaaacaatagtaaaattcctccttctcatggtgatccttactttattttaagttgtagactcttgattctacttctaaaaccttttgggcccccctaggtatcaagctaaacaaattagtgtgtatcattagactctacttgagtagcgacatagagtgaagggcaaaccaagctacgcttagtgacccaccatgatagagaggatgaataccatggtttttctattaccaaggtactacatttgaaccctttatcaagttacctagctcagaagcttttcgatagacaccaaagggctcactttccttattaaataaaaggttgacaatactatgttctaaagtagaaattaggatcatccaaaggcgcgtaggacaagctaatgacatttttacaaggataaagaacttgacccatgataatttatataaaaaataaatgtgaaacttatattttcgtaatagtctagtagaaggaagattttcctagttacaataggtttttgtccctgtattttcttattacaaatcataaagttattttcttctagggctaggtgcatattcctaaaattgccctatatctgccccaaaattggcctaggcttggtagataacaaagggaacatgaagttgactagaaatctttggaaacgacgatagaaagaggaagtggctaggccatggagtgacctgccatggcagagctgactcctaccatgggttagtcattctcgggctattacctcaattagatctatgtcatcccctgctcaagcattagccaaccgaacacttgatccttaagctcctacctgacacatcaagcctatttaaccaagagtacaaagaatggacaaatttctagtatatgcccatggcccaacagggggaacaatctttaaatacgattgataatcacaagtgtataatgatggcccttggttaacatatccaagataatcacaagtgtataatgattgcacctataattcacaaaagcatataccaaa

SEQ ID NO: 5137 - DNA, 1760 bp, Zea mays
  misc_feature (1)..(100): optimal_loci_48666_G1, chr1:283177442..283179201, Cluster 31
tttttctggatacatcacattttcttttaacaatcaagcccccccccccccttgtaatgcgtttttctagttgcactttctctccctttctcagaaagatcttatgaacctaagcttgttaaatttctattaggtagagcagttctattcgctagtctggctatgttatgtaaaatgtaccaacatagattgctgaatgatagaattgcttttagattgctatgacctcagattgctctttctgtattagtgatgtattataatattttcatttatttgttgcaggagcctggttcacatgatatccactttaattctgcaaacacgacaggaaacagtgaagaagggaacaatactggaaagaaaagagatgttttcaggccttctgtgtttgatagaatatctggccaccgtgaccaatggtgcaatgaagacaccagactgaattcagattcccatcgaaatcaatggagggaaatggaaaaagaacatagtgatatgaacaaagtggaacagcactgtgatgaccccaagcaatatcttggtagccagcggagtcgaaaagagcgctgggttagtaacgaaagaaactatgaccaacaccatgagaataattggaattctcgctggggtgcaagtagtaaagattctcaaaattggcgtgaaaagtcaacagattcagatataaaagatgattactcctgtgaaaaagttttttcttacagtacatgccatgggaaagaaaaggatggtaccaatcatgagaaggttaatgaaagggacagtaatatttctcgatcgtggaactccagctattttgcaaaccgtggtgcaggcggtacatctgatcatctttttacggatccacagaagttatctgcttcatttggatacagtagctataggcaggaaagtgatagcccaaactctacaagttctcgcagaaggtttacatctgttacaagcagagtcaatagtcggtcttcacgaccattccatcttggtgtactttctgagaggcctgttggtccatctagtaactctgtgagatatagcaggataaagttgtttgaaatatatagaacaactgatgttagaaacttcacaatgccgataaatgatattggtaacaatgagatatcttcgttgtggcaagaagatcctatggatcctttagctctcattgcacctaatgctgaagaagcggtaattttcacttttatgttgtctttactggcataagatcttgcaatgatatgatgcccttatctttttagttttgcttgtgttaataggtgattttgaaaggaattgaaaaaggagatatcacaaacagtttggcacaagcttgcaaagatggttctgatgacaaaaatattccaggcgtggcagcattagaacaaatgaaattaagtgagaagcagctcctcggttttgctatcaatctgcagaagttcttgaattatgtgttaattggtttttgcttcgctttatgcaggtggaagagaagatcaaacaggaaacaatgaagaattcaatggtaaaatgaccattgatatcagaggtatgcgataaatctcatgcatatattgtgaattcaacatatttgtttagtatcagcatcatgtgtaacggtttccaacgattgtgtaacagtatttattctatgcactttaaatacagtcatttcttggaacttagatgtattcgtgttaatagacatggttatgcttgagaatggttaactcctacagatttac

SEQ ID NO: 5138 - DNA, 1757 bp, Zea mays
  misc_feature (1)..(100): optimal_loci_52566_G1, chr2:4268150..4269906, Cluster 31
ctattgtctcccggtttccaagaccacgaaagaatgtgtggtgcataaaaaatcaaggagaaatagagagaaaaagagtaagcgacattaagaaaaaatgtctagggggataacagaaaagtgtattatgaggtgagatggtgaagtattttggagacgaaatctgaatcttataaggtcaatcccactgagagttttatatgtgtttcatctgtttttaataggctactacatatgtgttttttttctgatatatggcaacattttttaagaaaagagagtagaattgagtttcttatcatggttaccaacttttcataagtcataaaattaaatatttacaaaaacaatagaatgaaactatgcatcgatgaccatgttttatttcattctacgatgatgtgaaactctctactaagaagaataacgtaagctaggcaaagtatttcgaaaaggagggattatgtcaaccataattcataacataaaataacatagcatgcatcatactttcatagttatgtctaaactagggtataaacaatagcatacatcattctttcatagcttttttccaaatttataacaggcaccagtagaaataaaaataatgatcggtagacatatatttacacttgttctcttatccaggcatcggtacaaataatttcgatcattttttaatatgttcctgataatatttactgacctttcatgctatggtttaaaaaatgtcagtacgaatcgggaagatagtgtcagcttttcagaacatggggccgatcgaattgaatcattgaattgaaaattaagaaggttgtcaaaaaaaactcataaacgtaaagaagaccaatatattagtgcccaaatggtacgtatacgttccggttaatcttttacgtagattctagtagtaggagaggtaaaaaaaagtgtgtggcaactgttttgagcgtccaggatttcccgttagcatgtaaccatctgcacggcgcgcgagtacaagtcctcgcagcaatgttcctgtgctgctgcgtgattgcgtccagttccagtccaagatctcgtaggcggtgcagtgcagccgtcgagaccgccggccgccgtccttcttatggcgacgcgcgaagagaggggagcagcaggaggagtcgccggctttaccaggcaggcagaccggctttttttgaatcccagaccggctttttttgcgggagtacgtacatgctgcacgcatgcatgtgtgtctcggcccggccgcgcaactcgacacacgtcactttgctttggggcaagcactgtagcacacgtcaccgggctcgggcattgtggaattaggggccctgtggtccatggactccgcccaggatcttctgcgccactctctcctccatccaccgccgccgcccacacagcactcccaccagccgcggttaatgacagtcgtcccctttatcatcataagttttatatctaggacatgtttttcagcaagaatagagcgagctagctactgtttaagtacctctcctatataaaagctgttgctagcgctcactatcattaaactttagatgtcactataacttgggatatgaaggacttgttcaaaaagggacataaccgacagtttcttcttcttctaaaaactctttaattctcttaacatgcaatgtaagtagtaagcatcttcgtcggtcacataatgtgtcagtcatacttcgatccacttagtgattgcttgatgtgcaccggga

SEQ ID NO: 5139 - DNA, 2226 bp, Zea mays
  misc_feature (1)..(100): optimal_loci_53270_G1, chr2:7934241..7936466, Cluster 31
atatttcctgctgttaactagtagtataaaggagaggccgagaggaggttggtggcgttgccttctagctcgtcgtgtgctgccgccgaccggtcggtggatggggccgcgccgtcgctgccgtggcgaggtgaccgagtggatgaggcaatagtatagtaacatcaacacagatctgtctccaagaagtcaaataccaactcgttccatttcttatttaaatcagcactaaatattgtttgtcacacaggagcaacaaaatgccactggcttgcaaacttttggtctgcaaacataatgaactcaagcgtgcaaattctagaatgtgcattataacaatcgatgaatgaggggagcctcaatgtaccatatatatttttactcacagcttaactgaggctcccaggtctctttgtaagtagacaaaactcagattaacaatgaaaagacactagaaaaccatagggggggggcatgaataacttgatttttttagctgtatagagattcttactgtcacagataaattccttctgtattgttgttgtctttcgtaacttaaaacctgtatagatcgacagtaggataccgacactactttcttgacatataactggtttcatataggatgacatatttttatggatattgctatctgctagtataagctaacagagtttgactttagtatggatctaatggaactattgctatatctgcgataagatagattgatcatggcaggttctagaacttggtttgcagttcatctgtgtgtcagaggtgatgtttagtaccgtgtttttttttatctcattaacctgatacagattcatattttgctgtcatcccaaggctctttctcgactgaatcttattactaatctttacctcggaatcaataatctggggccaaaatggagtgaaagcacacgagggcacgcacgttgacgaacagtgagcagagcagacttttctcgaccgagtttcactatcttatcactgatcttaatcacctccgaatcaaataatgaaggccggccggagcgctctcatatcctatccacctagtcctcgttgtgtgcagcagttttcctctgacgccgtcatgcaggttccaactactgggaaatttcctgaaagacctgctgatatatatatactcagcgaattctacggtacgcctgcactttcaacgttagcttgcagcaatgacacgtccgagaagtgtcagcgttttctggcaaaaaataataacgcagcagaggtcggggccaatcttccccaaaaaaatcgatatttatgtctctttctccccgaggtactattcgattcattctttatttttgtatacatcaaacaaattactaataccaccatcgtatgaggtcggatgactgggcgttaataagatacttacgggcctcaataatttccagttgacccaatttaatcgaaacgggttattgatgattggtgcgtctaccttgagaactttcttcttggagaatatagtcaggctgactgtgcgagggagtgaccgaagaatataaatttctggttgcccaaacgagcagctatcgagacgattgatgattgaatggcatccgatacgactagagacgaacatagcgctccgatgcagcagcaccgttcgtcctagcttccacgtcggtaaaaaaaacttggtcgtacgcgtgtccaccgctgcttcaatctgaggcgtacgtgtgtcgggtggctgctcatatcctgcagctttagcttcccaataaaagattaaaaaaaagtgatgacgctaccgacaccacaaacaggccgatctagaagtggccacttttacaggcgagaagtgttttctatacttcccttcgcattccgccgtaagttgtagcttcctcatccgttttgaatcagccagacagggaagcaacgacgctgcgcgcggcttcgcttttctacgagcggtcgagcggccacagtggacctgcatgtgccttttgttgctcagttcttcaaaaaaaaaaggtgtcatacatttttctaaaaaagagatgatttattctttccccgttaaaaaggcgcacctttacgggtgcgataatttcctagagaacagaaagatttcacgctaaccattcttagttggtccctgccggacatgaataatatgatcaagtttttactattagtctttactacgtgagttcaatgatcctggccaat

SEQ ID NO: 5140 - DNA, 1648 bp, Zea mays
  misc_feature (1)..(100): optimal_loci_54088_G1, chr2:12281008..12282655, Cluster 31
aaaattatacataataggaaaggaccagtgtcccttgattctattaggcttgggttgcgtcctttaatcttgatagtgttgttacctatcatatacaaacttagggttgcgccccataaactcgacaatgttgttatctggcatgtaaatcatcatcttatatatatctatataaataagtatagtaagatagccttgtcttgtgccacttttaagactggctccctttagaacatccttgcattgcgctactagacaaaccatgaaatgagcaaaaccaatgaatcgaaatcgaaccccttcctgtgatctgactgcatctctattccctaactcaataactaatgtactagcctattgtcgaccgccaacacccatgtggcaagattaagcgcggctaaaggacatgatgtcaaaatctcatgatttaagacgtacttggcataatcgatgttcatgaggagccgaaggcaacgtacacacaagcgacatacttagtgttggtggggaagtggaggtgagctcgtcgatgatgagcacctctaggagcgactagaggatgaggaagataatgaattgagggttcgagagcagcatgtcaccgacgaacatctggatgcatggttgcatagattagcatggatacacagaatttagaaaggctttatttgttttctcctctccctttaataaatctagtgacacatcagcaaaatagttataattaatatattgtacattaaaaatatcctaaacaaaaaaaaaatcttccatatggcgaagctgattacaatagccctagcaagaagccaaaaggtcaaatgacgcatacacatagtgtaaaaatattattacctctccaatggtattttataaatggtcaaaaaaatctagatttttcccaaaccgtatgcaatacataatatacattccatcaacacgaaataaaatagagcgaggcggccgagttaatccagaatcgcatcccttaggcactgtttgttcattgttcttcatagtcgcttagccttacttccaccagttactaactactgtaaacttccgcgttatttcttggcactgttctcatgttctcgcattgtttacccaacccgcgtagttgccgtgtgcatgttaggctagtagtatcaatatcatggtgcggaggatgcacgcttagccgccggttagttgcaccaataacaataatatagattgttttttatgtattaatcattgaaggggctcggaattctaataattgcttgcttggtggtatccttcttataatctacgctaccatgtacgtagataatttttccctgagcaggacctgaaagttgctggcttatgtgcttttggtatccttttgttagtggttacattagctctgttttgttagtgcctagattagggatctcatatatatattgtactactagcatcttcccttttgcgctgttgctttaatttctttacaccgtgggagaccgttcgaggagaaaattacgtgtgtgatcggttgcttgtactagttttagactgcattgtaatctaccttactatataatacatagagcccaagttctgctttaaggactgtacaaaatatcacggtctgcataaggttatagatgttagaatataa

SEQ ID NO: 5141 - DNA, 1515 bp, Zea mays
  misc_feature (1)..(100): optimal_loci_54581_G1, chr2:15009782..15011296, Cluster 31
ttaagagacggattcgatctacgtgaagagcccgtttttatatgactctccatgcatattatctcttggctaaatatattatggctaaagattgtatcatgcagtgtctcttgtatttgaaaaaaactggtccaagtactcagggttgtacatgcccttaattactgtattatctttggagtttccaagaaacacatgcattgatgccctcccttggtttttatttacttatcatattaacttttatcctaaacaaacatttatattttaagctatcaattttaaaaatatatatttgttttgataatataaaatttatgttttatgttcactatgaaaaaaatctttgataatatacatagaatgtttgttgtaaaacttcaagaattttttaaaatgatcaatcaaaactagctagtgatatttgacttaggacaaaactaatgtaacatgtaaaagaacgaagagagtatattgacaaatttttactttttggtaaaacgaggtcgtcactgtctaaagtgtagtataattttagaccaagttcaccagactatataataaattatgtactcattctgttctaattatatcagttttaccttgttctaagttaaatgtctcgatcttccactaagcttactgtaaaattgactaaatcatctatataattgaattagttttattaatgaattctttaatatgtcttgatattgtttttttatcccatagacgttaataatatgtttataaaaaattgggggcaaacttaggctaattgaaaaaggccttagttgaaagctaagccgaatttgtgcttgtcagactctctgaccactgcccaaaaaagaaaagctagtgttctgtaatttgtaatcggatggagttcttttttttatatagctgggaaatgggcgaagtgtgtgctctgactacaagatgtatttgtgcttgtcagactctctgcaggccgttttttcttcagagtttctgactatccatgcgtgcatgcatgcatgccaacggatcacatcaatcagccaaagtagaggacatttcatggtttgatgtgatccaagttggaagtccggtctggaatctacagaaacatttggggagcaattaatgaatccctgccactgcatgctgcatatatatctgacctcagtaggcaagaggcaccttccgctccgcacctctgtttgaaaccagctacaaaaatttctctaatcttacacgaaacagaagtatactcctattctgcttctcaatcgatcggggctattaattgcgaaaggaagactactttgatagttggcttggcttcagtaacacttttgcattggaacccctctggtggcatttataatttacaagtcctgcagggtggatatataccaaatgtcataggtttcggaaaattggccagtggccttgcattgacgcggggccaacggccgcttagcagaactgtcatgtatctactccgagacacgatttgggctccaatcgtaa

SEQ ID NO: 5142 - DNA, 1537 bp, Zea mays
  misc_feature (1)..(100): optimal_loci_54669_G1, chr2:15493592..15495128, Cluster 31
gaagcgaagcgggcgcaacggatttggagtttcgtccaccgtctcgcggtcgcaggtccactgctattttggcggatcttcgggaaaaaaagggcattttcaacgataaatggcccgacagaagatcttgccgggcccccgctatccaccagacggcagactgccagtggacctcagcgtgttgcgatgcggagcggctggcctgcacccgcacccgcacgaaatgaatacacgggttccgggacgagcaaccgcaacatcaggaggaaatggacctggtgcgttcgtcgcgcaaccatcagctggtctatggatgcgtcagatggcaactgcctgacagctacagaacgtgtatagctgtgaccacaagcccaccagattgtctaataaagctggtaaatgaatcatatctcgaccattattcaaagcactagtatttgtgggatggggcttgccgtgaaagtggaatttagacgttttgtacccccatgtttcaaggatgtggtcaaacagtcttgcatgtcttgttgtatgacttgccttttgatggtagcatatgactatgctctacagagagactagctagtacgttgccaatattttaaaattgtctctgttttgttttgtttttttaggggagaatatgtttattttagaacgcagtactgagttttgcttagcaagcccatcgtctttctttgaggccattagttatttgggccgagtgcatctataggccgaactaggaaaaactgatgaccattaacccgcagatcggttgcacttgtactcttacatgtccatggctttgagaagttgaaaggagagaaaaaagttcattttaatttctttaactatcatcaacttattttctataaactacaaaatgggacatacagcttcggtagttttctcctttttatatctatgcagtaaatatatgatatgtatgctttattacaacgttttttgcagtatatttaaacctatgccgtatgtgattaaattgtagttgtagtttctgaggtccagttgtgttacggactaataattgaatgcttgagtcgtagaaaaagtttcatgctcattcaataatgtatgactaagttatagattgatttaggtttatgcttactaaacaatttttcattaaaaagtcacagatgtgtaaaaaataaaatatatgctctccatgttattttactattgtcatatgttagttctacataacaacatgattatgttaaatgttcataagataacaatgttgttacatataacatgagatatatcttaggtatcttatgaacacgtggcataaccacgctgttagaaaagaactaagatgcaacaatagaacattacatagagatttttttattttttaactttttaacaaacatgaatctaactaaatttataacctagtcacaatttttttttactatagttagaccataggaaaaaactcagtaaggagggaagggaaggaaagaccgtcctcccggaagaatgcctgaggtcgacaatcaaggtt

SEQ ID NO: 5143 - DNA, 1744 bp, Zea mays
  misc_feature (1)..(100): optimal_loci_55227_G1, chr2:18358510..18360253, Cluster 31
aaagccaactcatatcgaatgtttcattttggtaccgaccatatgcaccaatttcatgcgatcaagtgtaaccggtcgatcggtgctgatccgatttttcaatggaccaattggtatgaccgtcatcggctctagtgcggttagtgttgacctaaatgatcgataatggtcttttatttaaaatatacatagtacaaaattataaatcagaaaagatctaccatacgactcagatcacttgtgcattagtcaaatctaaaagattataaaacttttttttatttatttataaggtaaataattaaataaatatatgtttcatcttatatcctagaaagtaataggtaataatgaccatctgatcgaaataaatagacggtttatagttatttaggtgtatcttagtaaagctataacgtaaaaccttctcactctttagatgctgctccattttaaattcattaagagaaaagatatgtgagaagagaaggagagagatagacgaaggaagaggtgttggatcttcaaataaccctaataaccactatattacaaatcaataatacagattataccttcaattcgatcgctacacgatcatcagtgaagttctgcgctagggcagcaatgttcgtttaagcgagatcgatggcgacggtaagctttccattgttgacagccttctctcgagatcgatccagggttgaggtggtgaatagagacgacatggtgaaccttgtgtttagccgtcaacttccatctctctatttataggctacgctacataagcccatcaaccttgtcttcggctggacacctcaatcagggcacgaggtcaaagacctagttcgctgttagaccaactggaggagaccaattacaataagagggagggtacattactccctctcttgacaaagccgatcaaaattcgactacagacagaccacatccatatcttgttgtagcgtctgcccctgattacatggtgcaaagcgtgaggcgctccgtgctcgtgtagtgtcaactttcagcttcttcatctgatcaaagcctattatttcttgccatctgcctccctgatggaggctggagtggcgagcgggttttcgcacgccaaatactatgtaacagtttccatcaaggtatataacttctctgtttgcaggtcgcaccaaattaacagctacatacgtacctaatcactcgcgcatgcattaccatctgtagcattatatttctagtcgtccggcatcatcatcaagtattgggtagggaatctcttcatcatcatgatgaatgaatgtggaattgtggatccctcatagtcactacagcgtacagggctccagatgaacacagagagaatatatacttcactattgcaaccaatcaatgagtattttccttacacacatggagatgtgcagcagatattaaacagagcaacattttatggcgggtgttaggcgtgtgcttgcttagtccttaccttcttcagaaacaacagtcaatctatatctgctgccatgcttgcacgtgtccgcaagtgacgtggagctctataatggacaccgtaccaaggagtaggccgcaatccattatcctctgtgttctcaaaatatcactgtctgttcaatctgcctgaagaataaccaacagtacttgagataagtgtaatgtgaccacataacagcacacgtaagaagcaggatttgttgagaaaaatatatactcacttagt

SEQ ID NO: 5144 - DNA, 1396 bp, Zea mays
  misc_feature (1)..(100): optimal_loci_56084_G1, chr2:23115758..23117153, Cluster 31
ccaaaacaatcaggtgatggaatagtgttcacaaattgaaacgggatgacatcttttttcctgatcagttgcgtcttctagtcatacactttagtttctacgtcaaaactcgatgattcatgtactctcacagctagaaaattaggtaacaattctagtcaaggacatagccggccgtccagctcgtttgaaatgcattattgaggtgagcctctgctttgttttttcggagaactccaccgaatatttctgtgtacgaaactgttcttgataacaacggcctgatagcgagcatatacgttcagtatgacgcaacaacaacggcagttataaaatgaaccttacattcacatatcaaaagcacgactgcacgagcttctaaaagctaactctacatgagcaaacgaagatgcccttttaaattccgtggttgttggtacaaagcactactacaaaacaaggaatgctattgcctgttggtagcgaattgtggcaacaaaacatcccccttacgttaccaggtacagtcagtctgtcagtgttcatattttgtggcctatttagcgaaactctacctcagcatttgagtttgtttgagaaagcaattagtaaaagtgggctatttgaaccaaaatagctaggtgcaactcaactaataaatacccttaatatttaagtagctcctgctccaatttctcgagctagagatgaccaactaaaaacagggctagacatctacctaatatattaagcccttaacgaggtccatggactctgtgacgtacccatatacaagcactaaaaccatatattcaggactgctaaaacctttcctgatattctaaggatacgctagtttgcttctgttgaatgagacttgctgcaaaaagtgacgagaaaaaaggtttcagaggacatggctcagccagtctaaccatatcttatctagggaaattgagatgtagatacaatctggcaacttacagaactgtcggtggctcctttccggacctcgttctcatgtatgcgaacggtacgtcccaatttcggtgttcaatgaggatagattttattattatttttcagacctgatatagacaaatgttccgctttggaaggaaatgttgctgtctcgttgcggctatagtgttaacgtgcgtccagagaataatatagtgcaggtttttaatagatgtcatctcttctctgagaccgccggtagttagtcattgataaacacacgcccaagtcaagaaaacagggcgaagagaggaacgacagttccagcctttaatttgaatttcatccgttggatcgccattgaacttccgttcttatggactttgttccgatccgtcgttaactatagattcgacactgatgagccggtccagta

SEQ ID NO: 5145 - DNA, 1444 bp, Zea mays
  misc_feature (1)..(100): optimal_loci_56088_G1, chr2:23125193..23126636, Cluster 31
atcgagggcggaggcatagttacacccgtagtccacactatcgtcttaatacgtagtagagataaagaagagataagactattcactgtggggattttgtagcactctttccaatacctgacacatcatccaaagtgtcatgaaactttgagtgaaacaatgtctcttaatgtaaaaattcactttcactatttcatcttggaaacgagttaacattgtttcatctccatgaaactaattccatctcgtgaaactcaattctcttaaatgctatgacatgtcaaaaaatctaatgtgacatgacacactattaaatatgtatgaaaccaccatgaaactattattgagaatagcctaagtatattctcgtcaaagtatgtaactgaagcttaacaaattgtatagataaaaatatcaatgtttataacactaaattactatataaaaatatcatggcaaatttaatgatgtgtattaaatattgatttatttttgatacatagtcagtcatatttaagatattttaattggacattaatttgtggacagaaaatattttatgctgagtgtttctttttgctcgaagatgatacctccctcatgctttttagtcgtaggctatgtaataactcagcttcattggtatagtgttagtttttgctcgaaagcagctctagggtggagatgaattggttttgataaatcgtttggtgttagtttttagggtggagatgaattaggtgttagtttttgggggcaaatgcgcccatggccccattgggacccacccgcgtcagacgaagcggggccaagctacattttttggcatctctctcctcatctctttcagtgcgatttgcggggcagcggagggcagtttggctggtgctcacgcgaagcgctatcaaacatgcccaggacaaaatgcctccgctaaattccatctcccatgttgagttggttgaaagaaagtcaaggggactcattttcaagagcatggaagaatttgcatgggacaaacctcacgattcgctaaaaggactgcatggaagaatttttttgcctccaatgacgaaggttttagaaccacttggtcatatatagttttctttccattattgcttgaggacgccacacttgaggtcagtttactgcaattggttgcagtagtataattaaaacaacacaaggtcggttctgttatcacctccaatttctgattcaattactattatatatggagtatatcgtggtgctttgaaacccaccaattgctgtttatatatatgtatggtgctgttgctccgctcgacatctcaccaacccggccataaacgttttagatactaattacatgggcctttggtgcatttttctcttcccgatttaaaaggtacttaaattacccattaggtagtacacttcctccacttcataaggcata

SEQ ID NO: 5146 - DNA, 2101 bp, Zea mays
  misc_feature (1)..(100): optimal_loci_5825_G1, chr1:29672869..29674969, Cluster 31
ccaaacgactcatggatatttatagtataaggtctataatttgagctctcaaaatgaaactgaagccactcatggctagggttagtctagatgctagcaagaaaactctgatccatgtatataagagaactagtaagtagttgagcaagtcaatgaaaatatgacaaatgctactctatctcaaccaactaactcaatcaatatgcagaagctgatggtcttgtggtccttaggtgctatcctcttaggtaactaagctctatggaaggactcttgtatagtagtattgaaaaaaatactttggcactatggtccgtctactctggtagtcactggacaatgaaacatgcctaaaatgatgaaccctgttagatgtagccctatgaaggtccaacagtaagggggtcatctgagaccttatccacctcaaactcacccctctctcagataggtggttgtggtggcggtgaagtagtcctctattgtgcctaaggctaaccctctaaatagtaaacagggacacaaggatgtgtcgattgttaaactagtatagcatcttctggtggtgactaggcggaggtgcatctaaacctatccgaatggaactacctctcccaaccctcttacttcacgctatggtggttgctacaacaatcatctcctactaattgcgatcaagcctattgtgcttctcgtgcatcaactcgataattatgctcttgcccttattgttcctagaagtatgtaatgactcttgctatttgtccccacctaatggaggtggtccaagtctcttggtctagccatagtagttatctaattgactaaccgccgaagcactaaccaactataatgactaaactaacagaaaattcatcactaaaactcacttctctgaccaccaaccatctatggattgtctagtgactactgaatttaccctgccacagtgaaccttttgagccttggcctcatcctataatcatgggattgtctatgagtttaacaattcctaacatgatgtacaataaagtcaaaagaatctacataataaatatagtctaatggtattatattcctttttagagcaaagcaatttgatataggagaggagaaaagagtgtcttttctacatctcatgtgactatgaagagcaaaagcaaaaaggtacatgccacataaactgaatcactaactagaggcaatgatagaagcgagtgaggatcaaaatgtgaattgagaattaataacaaccatagactagaaatcaccacagcatgaggataagatgatcaaatgccaagacatgaagtcaaagggcaaaattggaggatttgggggctctcaagtagtatagtgtatggtagtagaggtttaaagagccacaaatcctaattgagttaggaaccctaaaataattattaaagagtaaaattagagtttggcttgaggcccacagtggaatcaaagggaaggaatttacacaaaaatgaaaaccttgggtttgcaatgtggaaacaattgtctgcataatagtaaggatgcacgaatgggcataggggtgtgaaggatgacataagcatagagcaaaacttaggttaggtggcatagggagcattgtgcaacatgcatcgtagaggtagcacactgcataacaaggcgcaagtgtaggcgagtggtgtgaggcatcaaggaaatgtatcttgacaagtgagagcatagtgcaacgaggcaggtggtgtgcgagaaggatctcttgagggaggaaagaacgatgtatcgcatttttcgaaggagctgacaagcggaatttgttagcatgacccacatgtttgagaacttaatgtgcactacacccaaacaacgaatatgtctaaaggaccattagacacaacaccacatatatgaatagtacgcaccattcaggaaaccctaggcaccaaacacatctagtgaaaacactagtcatgtctggtgcacaccatgtgcaactgtggttttaggatgaaataagtacccaaccttcaattaacatgtctagtgaggcatatggtgatttgttcggtgcacaaaaaatgtaaaaaaataatttctcatggac

SEQ ID NO: 5147 - DNA, 1657 bp, Zea mays
  misc_feature (1)..(100): optimal_loci_59242_G1, chr2:41741369..41743025, Cluster 31
attagaagagaagaatgtgtgctagtttgaaaggctatgtgaaggaatatttagggagttgttgaaaaggagctagtactacttgataggaagaatccaatcccaagataagttgaaaaatctagaacttaatgatcaagatctaaatgttcgatatgaattcttaatctcatggtattcgagtgtatgaaagacttggaaatgtcacacaaggcgtggaagacttgggaaagcatatgaggaaaccttaacgataaaggatggcaagctatatatcttcaaggacaaatatgaaaaattcaatatgcaaggggggagagtgtgtcttagatatcttctagaggctaaatgccattatgaatgaattgagggcctaggacacaaggtcgacgattaagacttctcccactatttcttgaggtgtgttcccaagaaattcaagatcattatcattgtgatcttgagaggaggattggagcttctcactcctacacaagtattggtagagatcattactcatgacacttttcatcatgaaaaatagagttatgagcaagagaaggacaagaagagcataacattcaaggtaagatctccaataacaataagaagatttaggatgatggtgatgataaggatgagatgaagtgatgattaagaggagatggccttctttatgtgttgttttggcaaaatacacaaaggagagagaggctttggtagaataaaaggccaatcatcatcatggagatcaaaggaagatcaaatatgttatgatttggggggggctagccacattgtagctgaatgccccaaaagaagaaggacaagtattctaagaagggaaacgataaaaaagatgatgacaaaaaggatgtattcttcaataagaagggatactcatattttctgagttagatttcaatgcctcaacatcaagggcagatgatgatgaaggtcatccaagtctcttatcaagaacaccatcaatattgatccaacactgttagactaattggcatgcctcatgtccaagggccctaaggtaaaatatgatgaaagtgatgatatctatagtgatattggagtttataaagaatattcttatgacaaccttgttgaagttctataagagtctcaatactttatgagctaggagatagaaaataggaactgaaaaggagatcccgagcctctagacaaaccctttgagaagctagaccaatcatgaggatcttttagaaactcatggtaggcttaaggaagcttaaaactctatctttgagcataatgttgagttccatccaaaagttggtatgagtgttacatgtgttttacttgaaaaatccaacatgtacccctattgtgactaaccccttttgtagcacaagcaagacttctatctagggtaatgaaatttacatgtgattcgtttctcactatgaagaacaacacactcaagaacgaggtggatgagctcacacatgcactaagaaagtgctatgtgggtgaggcaaggttgcaccaatgcttggtagcctaaggttctccttgaacaaggaaggcctaggctatgttatagaaaaggaaaaagtttttgctcctcacaaacaaacatttgtgaagaaaatgacaattatttttacaacgaacaagt

SEQ ID NO: 5148 - DNA, 2584 bp, Zea mays
  misc_feature (1)..(100): optimal_loci_64548_G1, chr2:72212566..72215149, Cluster 31
attaattggcatcataaagagacacacctatatttagaaacgtttttctcgagatcgcaaaattttgctaaataaaggtataaaacctcctatgcgtcttgatgcatcaagggggcaataagtagcttcgatatgagcaattaggacacgtataggggagggacactaaaaccgatctctaagcataagagacaactttattatacaatatagtatttataaatgtagtctattaatgaaatgaagaagtgaatgcgcatgtagagcatcaaatcaatataatagacgacatatttgtacaagtgaagtgaaagcgtctcttactacttggcttacgaggtagagacagctccacggttttttttataaatacccattaaacatcaatgtacgtgctcttatcagtataagcatactgaaacttgggctggattgcaggatttgcatgcaatgcaggttgcgtggttgatgagggacgataataagcatggcattaatggcagagtaggacggcgttagctgctggcaatggtgagacgaggcagcaggcaacgacggtgttggcgggaggggcatcgacaactaaccggcgcgcggcgctgtcgagaggacgatcgaccttgcttcaatgctgcgaaatgccacggggggtcgcagcgcagcgggcaagcagcccagatcatcaagcaactccgccataattgaatcttagtaccagtacccttcccttttcctacaattattgcccgatcgttctagctacgtgcacctaagatcgaccaaaagtagtgtacaccttaccaaaaacatcgatgttgatttctccaaaaaaaaaactaatctcgaacatggttagcccataagttaactagggataagattttaaacactaaattagcatcattatatacaatatttccgtaatatggttatttagcattacaagtagttatactcatttataaatctagtcaactatataaaaataacttagaatagctctaaaaaatggtttattctcaaatttagcttgatagaatattgtttaacagaagcggcgcctagctaccatagcaaccacatgcagaaagacatacatacacacacgtatctgtgtgagtccaggggggtatttaatttattctcatatttagctagggagctatttttataaaactataggaagaaggtccatttttcccaggaaaaaggtaatttgaaaatggttttaaagagcttttatataggacaaagacaaattaaagagcttttatattactgaaaattctccctagaaaattgaaaaaaaagagaggctctttgacgtgctcttcttataaaaatggaggatctcctaaaaaaccagcacgagctaggagctagaaaaagtagcttctaccggctcacatcttccatgtttttctcttcacgctacatcatagaagaaactgtacaaggagttatatttcaatcaaacaggatgctttttttaaaactcttcctaataataatgagggagctggttctttagaggagccagagctaaagctgccagaagaaaagccctaccatacggagccttagtatagatagagtttctatctttcgggtggaggctttgtgtatatcagtaagtgttatgtttcaacaaccgagaattacatattgcaggtgagaggaatatataattcaggctgcccctgcctgcagaaactttggcatcatctgcacacaacaagtgggtctgtctcggcctagacagcaagaactgcacgctccaataatgagaagactgaagacagaagcactgctcttcttttaagcaagcatagtacttgtagttgtatatatatatgcatctaggtaaaataacaagttgtgtgctttgacctgggtcatcactggcctgatggagccgggcgggcgaccggttctgttcaaccacggttgtactaagcttgttagctaggctcctgctggcctccctttgcttcaagaggggaacaagtgtgtgcacacccaacccaaccccctagctagctaaccccccatgcatgcatgcatgcatgcacttatcttcttttaataaagttcatcatctatcccagtggatggagtgcattgttggctgctatagcttaccagcaggggaggctacctatccttcatcagctagctagctagctagtttcagacaaagggcatgcatcttctccatatatatattaatacaacatggattagaataacatcttgccaagatcatgttcctgttccccgccggcccactttgcgtagctttgccaaaactacaaaatgtgctttaggtgggctatagtactagtagtaacatgcatgcatatccatgtagcggcttgtccacatctgaaagatctcacttgcacagcacttgtatatatatcgtctatatagaatatggtggctgacatccacatctaacatgcatgcatatccaagaagccattctatatgtttttttaattgcttactgcatcttcttgcttcagctaagaacctgcttgtaacagtagtattctgtatctatgtgccgcccaaattggta

SEQ ID NO: 5149 - DNA, 1534 bp, Zea mays
  misc_feature (1)..(100): optimal_loci_64549_G1, chr2:72215217..72216750, Cluster 31
gaatttgtactaggaatattgtattgaatatgtggatcgcgatcgtcttgagctagaagctatagcctatatagcttgctagacatgcacgggaatgtcaattagttctcgctagtttagatagagatttgagaccgatgcgcgcggctggtttcgtttcgttgagataactcttgcgcgtaccggccaggccagctgttgctgtactcctgacaataacacgaaacctttttaactgaaaggtttgggttcctctactttgaatcttgcgacagaaatgtcgaattgagttgagcaagtttcctgtgttttgaacatatatatgctcattctttcaaattcgaggaattgtaaacatacttggttagaatctggaaaaaattacttaggttagaatctggaattccctcgatcatcgacttggatctgtttgtttcagctttactactgttcggtttagtagatggacaacaaataagctgaatttttaaggagtaaacgatccctcgcaatccaaataagctacttacagtactatacatcatcatcataatctgcaataaaatatgtactttgttgtcatagacattacataggaggagtacgtcaaccacatcaaacactgaacagaaaagctaagattggtcaaacagtcacaactgagaaactcttggagagcgagactcatcaagaatcaacttcaataatttggataacaaaagaaaggcacagctaaaagtagttaaaacaaacgggaccttatgagcatcctttcggctactatggatcaccgccacaacatcaacatcaacaatgtgcagcccattcgaaggtctttaatttacatggaacagatggattattttaaagttttttctgtaagatttacttcatccgttcggttctccacaaaaaacacgtatgatttttgctatatgactagatatatacattatacagtcaaaaccagaacaactttcgatttacgatagatggagccacaataatggcacctacttacgctaattccacaagcaacctcgatcgatcggcggccggctctgtacaacactggcactttagcagggtcccatgtaaattaaaggcggaaaaacaaaaaaccaatgcaacaggccgaccacacacataaagcacgcaaaagggcaaaattaaaacaagtagggtcccatgcatatttgggtagatccaggtcgttgtatactgtatgccggcacgaactatgcgcacccaagtttttctccggttaacgggcatgttgtcgtcccttcgtcgctttggtgtggagtagatcatcgttgtcatcgccgtcgtggtcgtagatttagggctagcccatgcgctgtatttattagtccatacattctaaaataattactagcttcgttttttaatatttaaaatctcactcataataaatagaagataaatttgtatcatggatcttgaactatttttaaatcacaccaactacctttatactttatcttacgtttgtatcaggaaatctgttgta

SEQ ID NO: 5150 - DNA, 2912 bp, Zea mays
  misc_feature (1)..(100): optimal_loci_76564_G1, chr2:150794711..150797622, Cluster 31
aattaagatagataatctaaacaaacccttaaagttatatctaaatcagcattcttgccatgattaaaaataaactaagatatcctataaaatctacatataaatttgctacatatgtcatcataaaaaatagcaataaagtgtgtctatgtatgtttctaaattatatgcttctgtcactactaataccgtcctagaatacaaatgttataacttctaaaatctgtactgaaatgcagtgcattccatgtagtgttactcatatttggtaaagtttattggaaacgaaaccaaaactttacgcagaatttttatttaagttacttaagtgtttccttaagttgtcttaaaattttctataatgtatatattataggacaaatgatgtgtaaaagataatttaaaacaaacatacatgtcatgcattcttgcaaatcaagcatatatgcatgcatgcatacatgagccataaatattaaatttctaggaacccgtcaacaagaaaaatgttcctttagtgattcatataatgatgacactaacaacttatttaaaattatagtaatacaatatctataaaaaataataatgattaaaattataatgctccatcttttcgaaattattagatgttttgaattttctagatatattgcttttgttatctatctagatataatgtatatctaagagaataagaaaatctacttatctagaatggagagagtaattattatgtatgtttgtactttagaagaatttatagattttggttacaatactatatatatactgatagtatacttgtaagagctctttctataaaaaatactactacatgttaaattctttgatagagaataaaatcaatatcttaaacaccagagaaggtcaatgcaaactgaatgttgtcatgcccttcttgggttttgaattttgtatggagtaaacaacaacatttagacttaaatattaatatcatccgaagataagaactattggcttctcctagatcttacctacatctaggcctaggatgaaaacaagaagaattaatcgggataacccctcttccgcattttatttcaaaaacaggataaaaaattgcactagcaaatgacgaaaataaatcaaaacgaacagaaaaaatcgaaatggggcataaaaatgggaacatcaccgaataaagtatagaaataaagtagtattacgatcaattaaaaaaatctcatctagacatatgtaagcaataaattataatataagcatatggttaccaaacaaaataatcgattatggattagtttgttgcaatgtgacaaagttgtctatgatttatttattatattatataaaacgagatattatatgtagataaaaacaggatatcccgactaaaaatgaaaaagtgaaaatggtaggaagaacacccgtactgtttctgtcccattttcaggatatccataaatacgagtttaaatgcatgaatcaatgtagaaattgaagcggaacagaacatattttattccgaccattctcgcccctagctttgctcatgttgagcgatgtggttcatatgtaaatgaacatgtatataccatcgtcattataattaaatagtgcatcttagacatagaaatcgatcgttatctttaataattgagttttgaataaaagatacagtaagaacaagagtttaagctaatagacggattaaaaaattctagtatggctaataataagatcaaaatttgaaaatcaagatctatcatgacatcacgagatcatgaacaagagccaccacaactcaaaagtaaaagattcagctagatatgcacactaaagaccatgaacggactagccccatgcagaaacaagctagctagctagtgttcctcaaacttaattggcacgttgctgatgggaatatctgatatctgcatgtatgactagctagacggccggttgaaatgtagctgtcagaaaacttagctttcttttgaccagaccgaccacaccatgcatatgcacacgaaatcagccattgaaatgcagaatcatagaaacgcttgtatacatgcaaattgttccctgtcaggacgtgctttttttcaggagcagacgaaattgaaggagcaaccaagcaatatatgcatcaaagatgggttggtacgtggcctccggtttctgactgtttgtttcaatacatatacaaatcttttcatgttacttcttactacgtattaaactagatagattaattaaagccgcctccggtttctgactgttgttttaatagatggctagaattaaggctaggagaagctggaatgcatcatgtgtcagcaggatgtactggagctgctgcatgcggtatcgacttgggatttgacgcgcgctgcttgcactgactgctagctctaatgattggctgattgctagctggtagcagccatgcatctagctatctctaatgggcagagtgcagggcgtgcttggggagcataatgacatgttaacacgcccagtgaaggacttaattagctagctttatttattgggcttgcagcatctactgtattggtattcgagaccgtcacaagtaatgctaattttaaggatttgtgaagtcagccgtgcgtcacactcttttgcggtgacttaatatatgttctatataggacataaatacctgctccactagtttgtccttttgtatatgacaaatggcttttgtttgaaatatatagtcctataatgaattattcaacaattagtggcaacgaaaacttggcctgactttgtggtccacaccgtcattaaaaatcatattaattactttgagtttgcatgaagtaattaatcgatgctcctaagccttttctggtgcaggtttcaccgtttcattatac

SEQ ID NO: 5151 - DNA, 2090 bp, Zea mays
  misc_feature (1)..(100): optimal_loci_7782_G1, chr1:40558657..40560746, Cluster 31
taagacagagatatgaaaagaatctgagttgattttcgtcggtccaagttgagagctcgatgccttggcaaacctaccagaagcgcgtagtttatgcctagtttggtaggtcaactctcttgcacaaaacactcacgcctagttgaaagcctatgacgtgatggcccatatcatattgcgcaagtggggataaaagtaaagtgattagtgatctgccctggcgctgcatcgagacgtgacccaagtctatgtgtgctgtgctaacggtatcgttggcattatagtttcatttgcttttgcagtcaacgtcactgactatttaagtacgcagtacacttcttaacaccaagatgagcaaattaaattttctttgtgaatcttacgtcccaagtaaacttggtgtgtcgtggtttgtctgtgctcatgggggccggtccggtcttgttaaagactgcagcaaagcgccgcgtggtctaacagagctctccattgggcctttttgctgtaatgctagcgtatattatgaagaatagagcagatagtctactctgtaagctcataaatgagtcagttatgcgcctatcttcgtctttcaaagatcttatagtggatgtgtgtgtgtaaaaagagatgaacctacatgtacgattgactacgtctattgtgtgatttatgtgaaagaattatttctacgttattttttaaagagacaattaaaataacatgtttatatgctcgtgtgttgaaaggaccaagatgttggagagaggagtgaatgactaatctaaaattttcatgaaattaaatactatcacagtccattttatcccttatgtcgtctagaagtgtttctatcctacaacaaaattttgtaagctagatccaaccctatattagcatagcaatgctaagaatataaagacatgaatgtaaaattgctcaaatataaatataaagaagaagggttagaaacattggacttttcgatcagatgtaaaaagcttaaacacaagccatgaagcttcggtgctcaattgttcctctactacgttcgatcagatgtaaatgcttgaatacaatccatgaaacatcagcgctcaattgttcctctactacctgtgacaactatatatatagtgtcttcgtggaggcgtaacatgctacgttcgctattgaacctttatcctaactatcttaggatgtatctatacttttgaacctgtcagtacctattttatgtttatatctttggaccttcattttattagtaagtatgtttctatttcgtatgttggtgcagataattatccgtggtaccagcctgcgtgcaggggcgcgcttaatcattagtctggctggttttacaggcgctagcttttgcgtttttccgtccgaagatcagacgtgaaggtggtctcttgcacctcaagattaggcgattagcccatccagcaaggtaactctgggccatgatcccacagcccatacaccaaatcaaaagccacggtccgtcagcccatacaccaaaccaaaaggccgtacatacaaagcgagcagagcttttctccgtgatgctatggaaactggagcccacgaagagcacaactgtctggccctgcccatggcagatggcagcctgttccttttaccatggccatgatatgggtgtagtgtaggtgtaggagtatatacgattacaagcggtcctaaaataaatatacaagtcattttcaaggacttattaaaaaatttaaattttagccatatatatatatatatatatatatatatgataatgcattagtattcaagatgatattggattaagcatacggcatgtttttattataaacttatttagagatataaatattgatgctattttatatgtttagttacattttaaaaaaaaaataaactctttaacaagtgaatggcgtgtttaatttagcatggtagaaataggagtacgagcactctctccgttcgaaaatagatacatatttcgcttgccgaggaaacaaaacaattttaatttcaaccaattatacagaaaaaggatactcgtgtaataaggtagtctcgagcag

SEQ ID NO: 5152 - DNA, 1603 bp, Zea mays
  misc_feature (1)..(100): optimal_loci_80882_G1, chr2:176354432..176356034, Cluster 31
gagcgtggaggatcttatgccatcgcagcaccaactatcacctccgaagcaatgatgtactttgcaaccaaccttcaacatgagccacaatccgtactagtgtggttgcatggtcaactccaaaataatcaaatagagcatatttgagatctgtaccacatgaattatattttatttttaggaattatgtgattttatttttttcaagtaatgtatttaaatttgttttataaattatgtaatctttattttaagtaatgtttttaaatttttttatgaaacatgtactttttattggtttatttatgtgtctgatgtttctaataaaatgtcgtgttttatttgcaatacaaatatgtaaataaaaacttgatgtggcgttgggatcactataggctgatgataaaggttatacattgaaacgttatggtagataaaggctgacgatagtagatagcgtagtcgttagtgttagtgtggtcgatagttgaaagaccacttgcattggatcttgcatgaaagagaatgagttaaggttggctccaacgattcctggtgttaggatccttattagtggaaggtcctcaaaaagcattttcccatcaatcactcataaacctatccagtttaacagagcgaagtgacaaagatcgccttcagacaggacgacgtaaaacaaagccacgaccttcgtctggatggtatgcacatgcaatcccaaagccttccagagcacggtgtaaaccctcgagacttgttcagcaagacaacgacgagaagagacaaaaatacccctgattaatcttgtaattttagccgaagtttcaccttacgactataaataggagtacaatgtcatatatagggacgacttcttgagatcagagagatctgctacgctctacctacaaagtagtatttttcctttcatttcatttaatcgtttgtaaagacgaatgtatatttataatcattcagtataatgtaataaacgaaacaatgttatcacataattatttgagtaatctacatcgtttttcacttttcacaattcgtttatgtaaaacatattttgggctctcatcttcttcctttaattaatctctaaataaggagttaattaaaggatagagcttaaaaatcgatactcttgtgttatcttatttttaatatcttacaggaaaaaaacaagtgaccaacacccgatatagactataggtcccctaaccggatgtaaggggactgtatcccccaacggttcacggtaaatgttacatgtatgtattgaaagaaggaatctccttgtatatatagggagagcactatactccccatacaggttaattatatctttttagctctaattaagccttataacatgctaataatgtgtattatgacactacaaatattgtatgtttttaaattttaaaaagcgataaataggtgccaattatataagttgaagacaaactatatgtaggggaaatgtttttgcatatatatagtaaaatatattagaaagctcgaataaggttttgtgagggggaatagttggagagtctaataatagtgtcgcgtatgctacggatatagatagggg

SEQ ID NO: 5153 - DNA, 1859 bp, Zea mays
  misc_feature (1)..(100): optimal_loci_84983_G1, chr2:198864994..198866852, Cluster 31
aaatgaaatgcaactaattcatatgaacatataccgatgagtataaaaatagagttcagtctttttcctctctgctttcaatttagatcttgatcaaactttaaccatgaatttttagaacccatattataacctaaatagcatatctttagcacacatcttagacctaacgctgtgctttcatcttaatcaccaaaaactaaaagatatgtgcacgtgcacacactcggctggattaaccggatactagtaaatactgaattcatagttctttagtgagctgctgaactaggtctcgacttgccgtggtctgtatgtcagtgtcacacaagcaagcaaggtcagagagcgcgggtttgcaacgaatgagagatagaggccacacttccgttcagagccagtgtcgacgacaccgcttcttgcttgcgcaatgtgatatcgatcacgccaggtcgagagatagagcgccatcgtatcgatcgatcttttgcaccaggtgtttatacaatgaagaaggcatatatattatatatacatgtatgtcgacgtccatgagcatcagcaaagtatgtgagtggctctagtggccggccgtgtcgtcgtcgtcgtcgttgcagagacatcgcaacgtcatcagtgcactcggcctgtcgctgcccacggtgaagcgatggtcgccgccaccacgtctagctctttcagtgacagcaaatagctagaaggcataatacagcctttgttgtatttgtgtcgcatcatcattaggcctataattggcttaactcgacagtggtaattgctgatgacaaaaataaagacctatatataccacgtacggaggtacgacagctcgaggagtgtgcccgtacgtatggtatgatcaatctatttatttatttattccttattatttctcttttctatatatacgattgtttcctttgttcatttctgtagattggtttatcactagctagagtttgcaagattggtagggtagggtgcatcgtatatatacttcaggaaaaaaaatcattatatatattggcggctttgaacgtcccagaggagccatgcattcttgtaattttcttttctttttcaagggtgattgatgtgaaagaatgacttgtagggactgacaactcgaatgcaattcgtcccaagaagtgactggtgctatgcatagcgccaaagtttctttttaaaaagagagactcaattgttgagaaccaattccaattccaacgatgggtctaatcctattattataggaaataatgcatctgcaactgcaatgtactacaattatctaggcagctagctagttggctagcagatatgtgtgtttgctcaaatttggagacatgcgaggaactctcttggcatctacttcctccaatcccatcttaaatataaaaaactaactcaatctacctactaagacaaacatttttttaccataacatcaatatctataatttcttacaaattgaacaaacaagtttgacattactagctagctagatcccgatcccttgttattgaagacaatatattttaaaagatattgcctatagtcgaagttcgagaagtttaattagagaaactaaatggacccacatttacaatttaggaagtagtagaaggcaaactcatggtaaactaatgaagccatatagacaaaccatagcttatcttatccttttaacttaactatatacatatacttattagaacaaccccttgtgtttgtagttcaactttattgttttatcatagtttatctaaaagccaggtacgtactgtgcaatactacaaaaaatatttcacaacattttcaccaatagttcattaaa

SEQ ID NO: 5154 - DNA, 3137 bp, Zea mays
  misc_feature (1)..(100): optimal_loci_84984_G1, chr2:198867463..198870599, Cluster 31
agtttgactagctcgtgaattatttttagaggtcgtttttgttagagtcgtctctataaaaaatgtattcgctgctaaaaaattgtttagtattgattgttagttgatatagtagagattagttgtgataatgataatgaattgtcgctagatggtggataacttttactagcacggctgactttcaccaaagttgggcaaaactggttcaaaaacgtttgtgatgagctttgtgtggtggtggtgtgctatgtctcttaactcctagtaactttttaaaagttatcagtacagagctcatctagtgtgaattataaaatataaagattggttgcctagtggaggttgacttggttatctacttaggtcgtagctaattggtgcacgacatgcggattaataactcaatatatagcaccgtgttaacaggctattagcttttactccaaattcaaagggactgaggggattaattaagtcccttacaaatcaaaatcctctttaatctcctctagtccattattcaatcctcatggcttagaaataaaacgaacaggcctcaacaagacatgaataaggaagtcaagtgtagtagctaatagtagattattgtggccatgatggtttctacctgccgatataccatatagctagcgttgttagagaggccattccattaagtttgacacctcttggattgacccccaaattagtggcgggagaaatttaaaagtgtttgcttttgatgacaattaatggcgtagtgtcgtacatgcatggttggaatttagttaggaacgtgtgatgccatgcacgcagcgtcatctagcatttagctaaagttggctattggatgaagtgatggcttttcaggctttatcgaatgttttctatattttgcgaagtgttcaaagcagttgtgtccgatagtgtaccattccatcataatctaatttatataatctgggaatgaaacaaacgcacccttaatattgaataacgagacgatcgtcgaggaagacgaacaagacatgcatgatcgatcctaaaagcagggcacgacgcatatatatattaattaattgtgagtgacaaagtgcaggctcctcatagcgacaggtgatcgagtattattgttgtgcaagggtttaggactctgaatagctagttattggagggaatataatattaatttggccgcgcgccgtgagaccgtggctaacgatgggcggaaagcaatcaacctcgatctaatcttaagagatgagaggcaggcaggaaggaaattaaaattaataaaggtctgcttgaacgctgaaaaagcacgctgatcgatggagtggagagagatgtgacgagattattgcattgtctacgaggagaaggccgacccgatcgatcgaccctgagcctgaggtggtgttaaatgtgtggggagccaccactcccccgtcaccgtcacaaccaccaacccacatagcctaagaaatgcccaggaattcatcaggctcgctctattcattagcaaagcatcgtcgtaaggttttagagttttagcaaataatagctttacaggtaaagtttctaaaaaaaaactgttctcacaatcacaagcagggatagatgagagatgaagatgaaaaatagacaggtcgtgggtttggagatgaagacgaaacaaaagataggccgtgggaaagagcattatggtcatttaattacgtagttttgtctatcacgtagtttttttttggccaaacggttttattaattagaacagtctcagctttactgttagagccgtttcgttgagttaaaactaaaatttgctggttcatcggtggaatctgaggtaaacaatactttagcttggttgtagttgtagcaaataatattctggctaaaggagagagagagagagtaacaaagcgatgatagaaaggaaggtagggaattgaacgttggagcaactttttaaatatatactaatcaagtggactcaaacacccaggtctatctatctacatcgctttatattaattaatcatcgggtccttttggaggagctgagagtgagagctagctagcgcctctatcgagcgcccatacatacgttgcaattctcattattcaagtcaagtgttgacaaaaccgcgcgatggttatagtgctcaagcttcgtcatcggtcgctttgcaaacctaatcgcgatgattggtgcaaaaggaatgttggttggttggttgatgtgaggggatggatcggatcggatcggagagcgtgcgcgtatgatgatgcatctgagtagtccagatctatctcattctagtagtgcatacacttccaactactagtactactactaatcatgaatcgctggcagctagcagcaagccagcagcgacaaatcatgctatagctagctaactagagctagtagtcaactgtaacactcgagcgcgcgcacgcgcagagcgatttaatttacttgctttaatttgtaggtggtgtagattcactaagccagctatatatatagttagtagtaagctagtatagagcctgagcatgcatatcttttgcgtttcaatgtcacagtttggtagtagcaatatatatagtttatttatctaattaagcttgctgctccagtactcctcgcaatttttttggatggatcggacaaaacagtgatggattgcagatctgtgtgactggaacactagttgggaacacggcacacctatacctacttacttttatttgctcaatcaacacacaggcagacaaagaaaattgaaatgaaagggacagcctgctagctgtccccttattacaaaaggaattcgcattgtcccgggtgaatcctctatatatcggcactctatgttttgtttcttctctgccctgctcgaatgaaggatagatagtaaggtggtacgacgatgtgacactaacggttcatttaacttttctgaaggtaattaataagcagttccgttcaggacagtgacgtacgatttggatgcatctatcccagatcgcttcagctcatcccggcccgtcatgttcacggccacacaaacagactcgggtcccatccttaattttatcactgtcggaaaataaaaaccgtt

SEQ ID NO: 5155 - DNA, 1425 bp, Zea mays
  misc_feature (1)..(100): optimal_loci_87353_G1, chr2:212460892..212462316, Cluster 31
acaacaatgtacatttattttcttacttttggatgtgttacaatttgtcaattttgtaggcttgtgtagcaatgtgccccagtgtattgatcagatttaggcgtacgtgttgaatcattgcacataaaatatagtgaagcggggtaagaatatagaacagtgcatatataaagtgtacagctagcacttctgaatttgttttatgggccacgctgcctagtagtgggctgggaagcttattaatgtcgagatcaggccaaaagcatgtaaatttctttggataggtggtatttggtgggtcacttcgtacccaatcagattccacgatcaacatggtaggaacagacaagtacatatcacatgattctgaacctaattccagggacgcaatgctagctgtatgccacgctacagtgaccaatcttcataaaggtgccaaagtgtcacactattttatgcaaacgtatcgacatatataactggcattgatgtcgtggaaccaaatcaatttacaattattcagccaaccgtaccaacaaggagacaccaatataatgtacaatctacgatagattgcaatctaccatatagtaacacttcgagcaatatataattaatgaagcaacgaccgacactcaattttctgtttaataatttagtttaggaaattcatatcagatttatgacgatatgcatgtacgcgtatgatattattatttataataatagatgatgacacatatatgtgaatcataccgatcaaaacatgaacgactaaactgaatttcacagattcaaagattaggaatgtgcgcaacaacacggagggacacatgctcaaaggtggcactgtggctctaatcatgtgagttgacatcatgcgttgctcgaagtcattgaccatagttaatacaagtagatgtttaaagtgttgtctcttcggcgcccatcagaaagaagaagacgtaccagggaagaagaagacccacaactacaccataaagaatacgagcataccagggatcagtgagcagtcacgacaaaaatttttaaaaacctactcacctacacattctgccaggtgtctaataatgcagatatcaattctagaggcttgctctcccaactctcagtacaagtaagcataggatcatgaggaagcttcattgcaactcgaccaagaagagagaggagtggggaatttcttatgtgttcgttcagttcgcgtaagctagaggctctcgatgaggataatggtaggagttattagagtaataacctatgtgcgcattccttagcttgtacgtatcttacggatcagtcaatcgtttactctcctcaagagatctcatattaaatggggttttgcacataccctaatataacatttgaggcataggctgataggcgcatagcgtctcctct

SEQ ID NO: 5156 - DNA, 1912 bp, Zea mays
  misc_feature (1)..(100): optimal_loci_89367_G1, chr2:223642259..223644170, Cluster 31
ctgattttgaccatgaaaatattaattaattttagcagctagctagttgaggtactcacaagtgtaggaaattaaagtatatgagcacattagcttcttaaattggtcttaataatgtaaattaaaatatgttacccagacatcacaaagatgggaatgactaaagcggccccttaattcacattgaaactggcctgactacgttcaagctattcatggttggtttctcattacaaaaatataaagatattgagaatcttgaagtctcataaggatcataggccaatccacggaaattttagcatgcattagatctccttgttctatcattcatttgaagcctccaaagaaacagcctttttcttgaatattcctatgttgtgtgttcttgtatcatagcactggcatacaatgtgactctacaatgctcttatattttgccttcaccttcatttagaaagagccctacggtttggataatttattccaatggaacaagaacacaggcttttgaactttcggtgaaactgcattacctcaacgtacaccttctaacgagttagcaaaatgatgttccatgggaccatgaaaatgttgtgtggattctgagttgtcataattgaggaccagcaccatatgacaattgaaacctcatcacagagccagaagctcaatcgtaagcatcgatcatcattttgtgcggtcaaagtgtcaaacgatcaagtaatataccatgctaccaaaaaaacgttcttatgattgtccatagatcttgtgatcgcgtcatcgttatactatattgacatatgacagaaggataataactcttagggaaccacttggcactttgtggtggctatgtgtgatgatccttgaccaatgataataatgttaacaccctccaatgatgcacagatagacagaccacaggtccaccactaacacatctcctagtttgagaagataatattatgtgaagtacaaaagcaaaatcttgtcctgaggaccacaaggcactggtgagctcacaccatctccctgcctcccattgggatgcatttctattggtgtttggtgtactcaaaacccgatgagttagagaaagatttgcagagtacaggcaactttttggattaaaaacttgcatcgcacaccatgcttgcatgtccttttaactacctagtaggctactagcttggctgctttcaaagatcaccatttgtgaagatcatttctttttcttgtgcggaaccagagaattgaagaaatgttgtttcattgtttgaggaaacgctacatccagcaaagttcacatctgatttaaaattttgaaggggttatatacccacaatttcttatgaaaaacgaagctaaaaatgaaacttccgtgtaaaacctggcctgattatgcacagccagtaggcagatgattgcaggctatttgatctggaactgccacacatactgactagtatacatgtaacgtcgcactagctagcaactagtccagttctgcctgagcacagttgttagttgtctctgaaactaatcattttgacaggacgggcacggtgatcggagggcaccagatccaagaacgggggtggtcctgaaactaacaaaaaaaaaagatggcatagaagagaaggaagcgctgaaaaaaaaaagagtaaacgattaagaacagggcaagttgtgctttgcgaaggcctacaagatcgccacgggagacaggccacatgagcgcaatctgtcccctccttagacgagcctaataagcctcacatggtgcaatgcctatgcccataaacaaaatcccttttcgccctacgcaagggtggccactaaactaggccccggaatccttcctccaaggagctgcacatgagcgctgcacatgatggatcctttg

SEQ ID NO: 5157 - DNA, 2094 bp, Zea mays
  misc_feature (1)..(100): optimal_loci_92607_G1, chr3:2752578..2754671, Cluster 31
tagtggagccgtgctttcttgaacctggatgtttatattttaccgaatttattttaagaaagatattccaaacgaactaataatttgctaaatttatattgcttaagtgacaataaattccccctgagaaagcacggctcatgtcgtattggcatctatttatgccatggtggttgccaactttactaagctttacaaaagaaggaattatatagaagcaagcaactatagtttcataagacgaatatattaggtgggttactggatgaccgctatatgcatggtttctaaaaccatatagttgcttctataactatagttatagaaggaattacgctatatggttatagaagcaagcaactatatttttaaaataaactaattaggccatatattttgtatagtcttattttacaaaatatacaatcatttgaaagtttctaaaaatctcaaaatatatggtgtcggggataaactaattagtttatttttaaaacaaaacttgttcattatactattatacattgcatttggattaataagagaaccatctatgttaatagactaataatgaagacaaacgttttacgacaatcgtctacgttaaccaactattaacaaaggaggacacctaaaagttcgcctctattagtcgatcaacggaggcagggttgctaagacgatcgccttcattagtagacatattaataaaggcaatcacctttagaacacccatctctattatcatagattataagtgcacacataggagatttctatacgctcttgcatcattactgtaccctcttgttcaagttttaggtgatatagttctaggactagatctttggtggaggagagaggaaacttattttgttcatcatttatatatatttctttgtaatactactataattacatatttgtaattgattattaatggaggaggacaccttataattacacagtctgtctcagttaatcaattaacaaagaatgtgctgctaaggcgagcgcctctattaatgggcccattaatgaaattggtcacccttagaatgtccatccttgttaatacttgattataaatataattcccaacaactcccgccttctttatccatgagcacctcctttttttgattggttggagatctagaactctgaaaaatcaccgttttaggtactcctcgaaagagcacacgatgggagattcctatacactctcacatccttattgtttcctctttttcaagttttaggtgatctagatctagaactatatctatggtggaggagagagaaaacacgttatgttcttcatttgtatgaattttataatattgttatacttatcttatgtttttgtgtgatatagagaagctatattgctatctaatggtgtttttgtctatatttgtgttatttacaacaaattagtcattaaagtgattcaagttagtcttattaatatttttcgctacatgtatacaaggttaattggcacggaaaggtaaaaatggatgtactatacttcaaggatatcataactcttcaggccagatgaaaaagtttggcgatactgctcaaaggcaatgctttgcgtgtgaattgacaaggaatcataagcaagtcaggcttctagatggcgtcaaggccaatctcacttgattaggtggggtttcatgaagtgatacatagtctagaagtttcatagggaaggagatgagagtgtgttggtgcatttggaggaaatttcttgtagatagtgaatacagatcatgaagggcctcattatcattagtcaggcacaccattgatgtcaagaatgatttcaccttgatggatgattttgtccaaggtgtagtcgacgacagaggtgacaatgatgaggatcttggtgagccgtccttggtgaaccttgagaatgcacagttatttaaagattttattaaccgcctcaacaatgatgaccttctatttggaagcccatatggtaactagagaacataaaaaagatgaagtatgtggcaatggatctgctctataaggactcttcaaagcaatggaatatgttgtgttttgatctctgga

SEQ ID NO: 5158 - DNA, 1709 bp, Zea mays
  misc_feature (1)..(100): optimal_loci_93120_G1, chr3:5348393..5350101, Cluster 31
tttcaatgttttgaatcaacttttgtaccatgttaacatatatatacaaccattttatatttttagcatatacgcaaaatatgtccaaacgttagattaaaaataaaaaaacaagctactgctcacaacatagtagctcacctcattctatagaggttggagttggcatgacagcgactaaggacaaaagcaatgcaatagccctaggataggagggatagaaatctctaataatcacaaattaaaagtggtttctaaaaaaactaagcatgtaaatctcccacgtgtatggatttgatattttgaatcagctttcttactatgttcatgtgtgcaactatatttacatttttagtgtatgcacaaaccgtgtctaagcattagactaacaacaattaatccacaacaagctaccacccataatacaataactcaccttattcagcatatgttggagctgacatgtccgcgactaacgacaaaacaaatgcaaaaggcctcaagatgagagggatgagaaattaataataaccataaataatatatttaatgaaaaaataatcatgtaaatctttcacatttaccatttcgacgttttgaaccacctttcacgccatgttcacgtgtgcaaccattttagatttttagcatatatgcaaaatatgtgagcattagactaatacaaaataacaaaaaaaaaacaagctaccacccataacacaatacctcatctcattcaaatgaagttggagttggcatgacggtgcataacgacaaaagcaatgcaaatggcctcgagacgagagggatgtgaaatcacattattaatcacaaataaaaaaacaagcacataaatatctcacgtgtatcagttcaacgttttgaattagctttcttaccatgtccacatgcaaccatatttacgtttctagcatttgcgaaaaacgtgtacaagcattagaccaataaaaactaataaaaaataagctaccagccataacacaataattcaccttattcaatagaggttgaagctggaatggtggtggctaatgaccaaggcaatgcaaaattctcgagacgagagggatggcaaatcattaataatcataaaaaataaaagaaaaaataataatgtaagtctttcgtgtgtaccattttgtcattttgaatcacctttcatacgatgtttatgtgtgtaactattttacatttttttgaatatgagcaaaatgcgtccaaacattagaccaataaaaaacaagctaccatcaataacacaataactcgcctcattcaatagaggttggagctaccatagaggtggcatgacgacaaaagcaatgcaaagtgcctcaagatgagagggatggaaatcattaaaaaacacaaataaaaaagtaacaaaaatataagtatgtaaatctcccacgtgcatcatttacacattttgaatcacctttcataatatgtttacgtgggcaaccattttatacaaaatgtgtaaatttaatcaacaacaagtcaccacgcataacataatagctcacctcattcaatcaaggttggagctggcatggcggcggctaaggacaaaaacattgcaaaaggcctcaagatgaaagggatggggcatcattaataatcatagagaaaatgtcttttctaaagttgaacatataaatctctcacatgtatctattcgatgt

SEQ ID NO: 5159 - DNA, 1506 bp, Zea mays
  misc_feature (1)..(100): optimal_loci_93765_G1, chr3:8330951..8332456, Cluster 31
gcagatcttaagacatttcagaaggctaaaactggttcttggaatttttccaagcatgtatgcaatggatttaacaaatcaatggccaaaggaactggctaacaagcctaaatgcttgaaatttccaagcatttggttgcatcagacaaaagattccttaactcctcatggtttataaaacatatgaattgaaggggtatattatgagaaatagataagggtcaacgcatattatcagaagataaaagaacactagagacaaattttatgtcagtaacgatctgcacatgaaaatatctgcttccctccacaaagttgttgtacagatatagtttatataacacatagaggatgacaaaaaggaataaacatagcaataaaccctcgggtgcaacatgcaacgttaatagcttttctgctgcaatctcagcatttttttttcaccttctcactatcaatctacaattctacattctctagacctccctcaatctatagttaggacctgttgcatctgtcatgggaatggcattgtaacttgtaagcagtataacattttatgtatttgtttacacattcaatagatggcaatgtacaggtgccatttacaaagcgagtgtaccaacagtaaaatcaatgatggaaggttttaagtagggtagaatcatgaatagtagtacagtttttttaattatcatccacagcacaagtaataagcacttcccttccatggattaggtgcagtgacattaagggatgttactacagatctaacgaagcaattggattttaaatttaggaataggataaccatgtgactaattgaatacaaatagcatatgtgcttgcctagaagatttcttacttctgtagaaggtgataacatgatgatgacaaattatttaagaggtcctcaatccacatagtgtctttaaacactttttggtttgttagtttcagtttgcttttagaacggacaggcacacacaacagatgagaagaacagaaagtttattgttgtcacattgttacaatagggaagacattccacatcgaggtacaggtacttaggactaaccgtggtgccttcctagcatgactactcccaacaaccagaatcatcaaggataaagtgttgccattagatttagccccgagaatgagtatcagcttcagacatgttaatattcaaaatataacagctaaaatctttttacatgcactattctcaattatgtcatttaggcacttccaaataattttcaaatcaaagacagacagataggttagaaattgaatttgaatgagaaaattcaaaaattacagcacaattacttctaggttctaacacatttatccgttttgagaaattctttagatggagatcattgaaatctaatgcatgtaaaattttcacgcaatgttcaaaaggcatactattctcaattatgccaaaaaggtgatttgctaccttgtgaccagaagaaaggttctaaattctaatac

SEQ ID NO: 5160 - DNA, 1813 bp, Zea mays
  misc_feature (1)..(100): optimal_loci_97394_G1, chr3:28213745..28215557, Cluster 31
tttctatatcagttactccatccacaaattaaggtcgtagaaggcctttatgtatggtatatcaatataaagacaaaaacttgtttaatttggtccatctcgttggagggtacgtctgaatgggctatctcgtattatttaatccgtccccagaagagatgttggcaaatcatttaataaatgttggtttggccaagtgaaatactctacaaacagttgcgttatatttgtgggaatttgcacgttacaaataaatgctttgcatttccggatatatactatatatggatgaatgaattgggggctgagggtctattatatttgtgtgtttccaaagttgtctctttctgccttttgaattttaacagttggagatttttgttattattcgctttagtaataaattaaaactgcaggtccgtaatacaccaaaaggaaaaaaaaagggaaaagcttatcagtacgtaatttctagcttagtagatcactccctcgtaaaaactagtttatttggaccatatatattgactgtatcgtctaataatgagtgatcgattacatgtggttccaaattcttattagacacagtcgcatacagctatgagcaaccaatccctagccgcgcacaagaacatgcatatatatgtatgtacactagtgtgttaatttcaaagttggagctgagcactttgatgcagtacatacacagatttgtttaatccttgcacttagctggccgaggccatatatcaaattaatacaccgctgctcgtcagtcacgactaggagtcgtctaatattaaaaacgtactctcatctcggggcaaatatagtattacccacatctgccagtcaaatttgttagttaattacccttcctttgggcatatatacatttatatatacaagaaagtagcactcgattccatcgcggtgattaaacaacgacataagataatcttgcattggagatcccttgaatgctgaagtaagtatatatatagctagcaggttgattattaagttgtgacgttgcgtacgtacataatgacgatcctagttgcgcacgttgggacgtgtagtacgatgagtacgtacgttctcatacgtacgtagatgtttgattagtagaccaccacatcacatgcgtgggctagcacatgcgctgtcacctcacctgcgaattgaatgaagtttgaatcttggaggatcagccaaagatcgaataccatacatgcgtgcgtgtgcgtgttccctaattagtcgtcgtcgtctcaacttgttttgcaatatagtggcatctgcacgatacctaacgaaccaataccggcccgacctactgcgaaacgtaaacaaaggagagatcccgcaagtcttctcacacaagcactcctctccgatccaaacgacatgaggatgcagctagctaggcctgcctcgcaaacgaattaattattgagttgatatatatacacacactgtacctaatatattcatagtgccagattggttagctatgtaattaaaagttttgggcacggtgcgtgcattatatatgcatatgctgcaagcgtacgcgcagtcgcgcagacacgggaggcgcgcgcgcgcggggggggacggagtcacggagggcagatcgatcgatagcatgtcacgtcacatgcgtggctatctatctatctacagaatttgaagtccagcaattggcgaacgtgcgagatggacagtggcagtccagtgcagtgcatgcacgtgctacctactaccaccagctcttcgaccgacaaaaccatgttagcaaccattccta

SEQ ID NO: 5161 - DNA, 2031 bp, Zea mays
  misc_feature (1)..(100): optimal_loci_97861_G1, chr3:30551813..30553843, Cluster 31
ctactcctcataagaaacataaggatatattatatggaccatttggtcatgagcagaaataaaatagcttaaaaatattgatgccacagtaaaccccaattattcaagtacctaggttacaaatggtatacaactccaattaaagatctactgcatatatcatcctaagataatggtaagatattatctacatctgcaacttatttttgccagattatttatgtttagaacctctggcttgtccattgaactctgctgtatttcaacatcattgttatctctcatattacagtagggttcagccctaccaatttcataagaaaagaaccaacaaactcaatcaacgagtaggtaagaaaagaagtggaagttccaacaaaaatagagctattgtagaaacacagtccatttttaaaccaacaattacaaaaggaggaagaaggcatacggcgatggaaattttttaaatatttgcaggttccatgtatcttctgatagaaatgatgtatgaacttggtcctggaagaagaggaaaaaaacattagaaacacctagtggtagctataagttactcacaggaatagttagagctcatcctggatggaaagtaggtaactgactgaactgagagtgggaaacccacccgcatgatcattccacccagcaaaatcagagctgaatcagcctacaaaagtgcacaacattacacgatcaaagggtactagataggtgacacataatgtaatgagttaagattatctttgtaagatggtatataaacagctttcaaatcatctaatttggcaaatgtcatgtcaaataagcacttccaaaaaattgattaagatactaataatatttgcagtcctgacttgtcctttccaaaaatatatattacgggagatggataaatcgtgttgagatcgcagctccagatcaagtttacagtgataaaagtactgccaaactttcagaatgaagttctgaattccaatctatagaacatagattcagtgaaaactttaattgtattctagcaattatggtgacatttcactagttcataagataccataagcataatgcaagcaattagtaaagaataactgggaaatacatcattcaatttgagagactaaaatcccgaaaaatggagatactggaagatgtaaatagagcagataactcttttctttaatggccaatttaatttataagtgtttcattaatattcaaaaaacactatccaaccaatagttggataccatttcattagaacgagtaatgatacgacagaaaaaaaaaagcaatgcaacaacataaaaaaaggccatatagtgtaatttattggtgctcacaactagatctatgctgcttaacaacggaaatgcgtgaacaagggaattccatatggcttgccaacaatcttcaacaattgacatctgcaataaacaggtaacttattggatgacaacatcaactttaactttaagttcatgatggattacaaaaatgccaagacttgattaggaaaagcattgaggtacaaaattcaacatgataaaaactataagcaaacagcctgctcagtactgcttgatgtggctgcaatactgagtgcacccaaaatatagaaaacagtaaaaaaaaacaggaaacaatttgtttttatgagtaattatgttaaactagagccactatggttatccaaaatttaaaatgaaccagttggaaagcagtattttcttatataataaagaactagtcccattcacaacatgtatatacagactaaagctatgtctgctgactgtccaagaataataggttccttcaaaattctccatagtcttgatggcgtggtgccaagcaaccaaaatcattcttttagctagatctggaatcaaaggcaaaggggtacatagatagctggagtgtgagtgacctggttggtgcatgtgactcaaaatgtatcaggcagtcacttaaacttcaaaagtagcacctctaatgtaatcattagtccagtgt

SEQ ID NO: 5162 - DNA, 3580 bp, Zea mays
  misc_feature (1)..(100): optimal_loci_31764_G1, chr1:195178584..195182163, Cluster 32
gatctagtggttaggaatattgggagattcaaaggatccatcataaaggccctctaatggtaaaaaaacaataattggcgcaaaccacctaattaggtctaaaggtcacatgacatccataaaactcattagatccagaggaccgatgctcatattagtcctagacctaattaattagggctaatatatgctgaaccgaaggtctattctctatcagtgtgttttgaggattaaaatgacacagtttatgaatagaggtccgacctgcgtgacacatctagagacaagctagtgtatgcagatcgttcttacactgtacgtacgtacctaaagaagtaagaataaaaaaaaacctataatttagaacaacgggtgcatgaaacatccaactttggtgttttcgtttcctggatttgttatatcggactgttgtcccctctgccgaggcaacttcgaaagctacgtcttggatacatttctgcggcacttgaggaggtaacgtgctttcagtgaattctttgaacaaaaaaaaaaaaatccttgtcactctccatacacacacacacacacatcacatatacacaaaaaattaaagcggaaaaaaggctgaaattggttggtcatatttatcgtggcgcgcgctcgtcaacagaggataattcgttgacaacggggaggagattttgtggttgtttccacgacaagttggttaaagaaaagccgccgcgcgcgccgtgaaaaccatgcaacgcggaaaaagaactactcgtatcgtctatcgaagagaagaagtcacatggaacaagttaacccgtgttgattgagaacgaaggagacggggagaagaaaaaaaaacagattttgacagcgcaaattaaagagacgcgtcacttttgttttatatgaattcactccgcgcgcgcgtacaaaggaagccatgtatttgtcgcacgaaatcgttgcgaacgatccatctagcactccgtccccggatgacaccagcaagctagctagctgaatttacatggtagtctgatgtgattgtttgtgcagctagggacagatctaaatttttctcttctttttatcttagtcatttcacactaaatcaaatagtgtcctgcgccatagatccgcatgtggactcgtattattgtacgtgtgtacctttagcagtttgcaacttccgttcggcctagttgcttgctggagttactccaagattagcattaacctgccacgctaatggcgacgtgtggaccaatcaccaatgtgaccgatttgcttgctactagcttgtttgcatgcttcctatagctagcttcttcctctgtgacatactactggttgatgtcattgttcatgtgtctaatgcgtgcagcactggccacttttacacgtttcgttttggtgatgatataatggtgttagggacaaggtgagcaaattgcgccactatattagttgacctcgatcgtttgtgtgagacgagagagagatcatgtaggttgcagccctgtacgtacgtacgtacgtaatgtacgtatgcacatgactgagtagttccgtgtgtggtttgttgctgcatttctctctcgttcacggtgacgttgttctagctatagctggcgtgagcttcttttattaatataacaggcggggtacggtgttgctgaatgaataatacatggttttctgtattgctgaattaatatagcacatggcgatcatgcattatatttgatgacgaagcttttcaggccctgttccaaatgtctatagctaattgttagccagctgataatataagttgttaactggttttagctggatatatttgaggcagctaacaatcactagctatttgagaggtatagctaacatttagttgatccattagctaacccgttctaaacctctcggctactaattgttggttttagaggtttgaaacagtgccttgattaactcacattggacaccttctttttagtatatatgtgaatgagatgtcgtctggcgccggcatccagaacttggtgcatggccgattatattagtgtggtatatatactaatgtgaaggtagtacaggtaatcggtgcatgacaaagttgggggtttaattactagctagccaataaggtggcaacaaggtttcttgaccgcgcccccccccccccaaacaagcttggatgttgttgtgatgacatgtgcacgtttgacgacgcaagcacaccgccgcccaagaaacgaaacaccacaaggatggatttcctatatatgtgtaaatgtaataatgtaacgtaacccggtcactcgagagcagcaaacaaagacaaggacatatatatataatgtagtaacccaaagaagaatcagatgccatctagctagtaggccacatataaaggagctttggcggcgatgcaattgcaaaggccccggcgcgcgcgtgcgcatgcagccgcaggtgctcaaaagagaggaggaagacacgtacgtacgaaagagagaaggaagcagcatgcatgctcctagctaagctatataggtaggaaggaagaaaccgatcgatggacgatggatcatgagcaatgcagcaaggaacgaaaagccagctaaaaaaggggagatcgaggagggagaaaaggcaagggggacatatgcatgcagcaaggtgctagctagctctaccaaccagccaaaccaattgagatgccctgcaagcaaatctgccatatcactgcacttcacacaccaccactgacactggcttgcacggcttcggttattcaatccagtgccagaggtgatagatatagatgctgctgcctttttttatattatttatatatatttgcatgcctgcgtgtccactgcattgctttgcttcatgcgttaagaaaagaaaccccaccatgcaagcatcttggtcagccgtcagtggaggccggtcagttgcgttggtttggtctgcgtggctgaggatcggagtagctagcgccaaatctgccgggcgaaataaagctgactgctgctgattagtttgcgacaaaaaaaagccgaaaaccacgcctgttaagcaagcttggtatctgggctatagatagcttcagccgctgttactacatggctatggcttcacgtttcccgcgcgcgcctcattagcgtccggcaaggtttctttttttaggttgatgcgcgcaaagtatagcagaaagataataaagtcagaacgtccccgtttggcatgcatcttacagtaccggccggtgttcacggcataatatataggacgtccctctactttgtattgatatatgacgtggtttgtttatgtgtgttgcttacttgctttagacccagattgtctagtactctcttgggttttttttcaccgttttagtccaaaaactagcaaaaacaaatatttaataacgaaggtagtagtaaattgggtctagtgccttgcatagttgcatgatagcatgtaattaggccatgtttgacaggcatccatatggctccggctctatgctatacttaatagcgcatccataaatggatcaaagaagggg

SEQ ID NO: 5163 - DNA, 2376 bp, Zea mays
  misc_feature (1)..(100): optimal_loci_113176_G1, chr3:131333147..131335522, Cluster 32
tgaagtcaattgtgaccaacttatgatgtttccttttgtctagttcaacatatagtgtatttaactccataaactgtttgaaatgcaaagttatgattatttgcttcatctagctttacatgtggtctacattgccaagagccacgaaatcaatttctagtggtgaatggtgttctcgacctcctctagaaacacctccatactctaaaggcatgttggaaacaactaccactagaaatatgatttctaaatgttgttaacgttcatatccattgttgaaatatatgaaatttctagggcaattgaaaatttgaatccactctagacatcgatttttagaggtgcttatctctaatcatatttttatagacgattcttataaagacgtctcaaaaaattaaaagatgactctaaactaacttatgtagttatgttttctagatttgatgaccttgacagtcatcactctaaagcttggaatgggaaatgtcttaagaaaatttaatggttagaggagggtgaatagcctaactgaaattttctagcactcaaaaacaccaggcaaaggattagacaacaagcattaataactctactttggtctagctacatattgcaaacctaaaagtgagtagaacctacatatttctagagatcgagatataagctaagcaaagctcagtgcacctctctggctctctgatgggtctctagagatttctagcgagttctaaaaccaactcaaaaaagcatactctctctaactatgctacggtgcaaaccttcaatgggatctatgaagagctcctctactacatttgaatatcccacgcgttatctgcttgtcacaatcaaactcgagtgacctatattctttgatggcatcgaaagttagggttgccattgctgaatttcgatggtgcttgaggcagtgaattaagctctagtactttagtcttgtcatcatgctagtagtacatgttgtgcactatagcacttaatcgaggaccacaggaaaggccctagaataaccatattatcttcattagggtaatgaaaccataggatcaagtcatagggttaatgtcgcgatacaaccatcaaaatttacataactcaaaaatcatacaccacattgattaaaagaatattaaacttataaggtcaaattaatttaaaaacgtacaatctgtatttagttaacccaatgaaaactagctaattagctatcccatggtctagtttcatgttcactaataatgacacgatgagaacagttagagctttggaggaatgtccattccaacatatttaaaagtttaatagcagtgcaatgactatgatggcactcagaagacttattccaacataatcatttaggggttgaaaaggagaattattaggtattgtaaagtttgtggaaagcatggcgtgaattgatgtatgacatgctatactcaactatatatttactaaatttacatatttaaggaaaaacaagtgatcatatgaaaaagtcaattatttttacacatcactctcattactataaatctagaagaaacaaaacaaaatcatcgtacgaggatgttcatgcttttggaaaaaattctatagagctgcacatctatacccacatggagaccaatggtgaacctccatatccatgactaaatatgggtcgcctctaggttccaaattttctttagtgtggctctatagaccatgaattgtacgacaatgacatgaggtacttgcctttagctatccacactatatcccaagataaatccacgtgattagtgagtcaccattatgtactcatcttgtcactcccatacttattatatacatgagtatccaaaatatgggttgttagtactagtgacaaacaatcatagtgtataagtgattttgaagggtcatgaaaacttctagaaatgccttacataacatcttgcctgtaagagatgtaaccgagattgctgataaatgttgataaaatgagtgataaggagatatagatcttctcatctttaatggagagcttgttggataaacaaagagtggatttgagttgtatgaacatgtatttatacatagggtagggtggtcatttctaggttttatcggttagtgtgttgcgagactatccacatgtttgctaggttacaggcttagtgttcctatggatagtcttgatgttcttttagattgtttgagacaacaataaatagtttaggcgaacaatacatggatgaatctagggttgtattagctctgagcgatcatggatagtctaggcgcccgtctaaacagtttgtgagttcgttagtagaatgaaggcatgtaattctttatgctctgtggggttgc

SEQ ID NO: 5164 - DNA, 1562 bp, Zea mays
  misc_feature (1)..(100): optimal_loci_120279_G1, chr3:175532613..175534174, Cluster 32
accaaacgtacccttactcccgctaaataatcattcaaaattactctactgaggaatcaactttcgagttagagaattagaaagtggagctatgccaataaaggaaagtcgagatgaacttgaaaataaagcagttagaagctcaaagcttgaaaattaatttttgaacgaaaaacctaaaaggtaccactcgaacaaacaaatcattattaaaatataaaggaagctaacccagttacccttactgctaatttaggtacagtcgcccttaaggagaagctcatcatgaacacgcttcaccaaagtctgctcgtcactcttcacacagcagcaggtctttggaccgtggccgtggcgtgcctgtgacagactgtgttgcaaattttcctgccgtacccgtacgggtgcggcaagcatgtgcccgtgtcagtgataacgcgatcctgccatgcacgctcagattacaggacaagcgtgccactgccatgcaagtagcagtggtgtccaaatgtcaaaaggtccacgtgaacagggcaaaaggagacgacgatgaaagacctctccggacatggcatctgaacactctctctctctcttggcaccaccaacttggaacgttgaattttgaggcctgcatctgcatgcctcgtaatgccttcttgaattctcatgatgcattcggatcaaacgacaaacggttttttgtaatgtgtgtgtttggcagacgcgctttaacatcgtttccgaggaaaacgcatcgaacctcgcttcgtgttttgacgaccaaaagcaaaaggttcacaagcccgagatctgaactctgccggagtaggaatcatcagatagccaagatgcctttcctccttcagctttgccttaggatccaagtttctgtttctttgttttttttggggggtaatgcgtttggccaaaactctgcagttcctttctgggacagctccatttgtttacgagacaacagctctttgaattattctctgtcttcgtttttttttgaatatctaatagtaatattgtacatttggtctccttttccctggagcgaagattctctgcacgcttattgatgtagcagagccagcaatgtcaaacggtttgacaaaagtggctactttgcatgcctcctcggcaaaaggccaaaggatatttgaccttggcaaactgaattttcagtcagaggcgtgcgcatgcccgcgccttgaccgctaactattggcatttggcagcagatggtgtacagattattgttttaaattgaagactgtgctgttttagagtggagtttgaaatgatagaaaatgaataagctgttggagataaggcgctaaggatatccacacacttgcagctgtttatacatcttcaaagctcaagctctctaactctacgtttaattttaactaagatttcatttctttttttaattatgtagcatcttagaaacagaaatataaaaatctatcactgtgaatggccttagggcatatgcaacctctcatttaatatagggtttcttgatggtctctagtagttaataaaga

SEQ ID NO: 5165 - DNA, 1465 bp, Zea mays
  misc_feature (1)..(100): optimal_loci_122041_G1, chr3:184634286..184635750, Cluster 32
ttcatgcatgccagtataagttaatctgcaatatgcatcagtcacacgtagttagttactccatcaacagttgccagttacctgtgaaacagcgatgtcatcctttcttatttgcaattttaataatgcatgaatggctcattagctccagattgcaaggttcttcatgctatctttgacacttaaccatattcgacactagtgcactgacatcgtaagtttactttatatgtctcagtccaagcagatctcttatgtgatactgattagtttcagagtttgtaccttcctgaacctgtttacagagtctgttcaatgctgaacttgtctgggaaatggctttgaagttgtatacttgcgagttaaaatcaatcacatctcttatgtgagtcttgaaacttttttaccttgccaatcgataaattgcagaatcgaaatcactactgtcattatatctggttcctgggttagtgtgctaacctgacctacttctattatagatgtgtgctccatgatccgatacatatgtgcttgtaatttgtaaattgtcaagtctgcggcagtgatatatgataatgtcactgggaggtgtggggaaacagttttggttcccactccgtaggtcaggtcagcactgcccactggtccacacatttcttttccctttttctttatgtctccttgcctttaacatgatgcctgcccctgctgtcttccttttgggcaatatagttttcataatcctggatctgtgttcctggtcattgattcattgggtcatactaaagtttcttggactaacgaatggatttataacagaattttgaaatggcatgtgccattcaccattaaaaatgataaaataaataaaaaactagacagttggattaagatacatgatttcttcttcttctagggtttcaatttccaacatccaaccaatttatcaatttctcactatccggtgcaaattttaatgttaaaaactattgctatttgattctgttttgtatgtctgctgttctttagaacttcctagatctgcattttctagcatcagaccctttcggtacacaattgttgcgcgcctttcatggtgtttggccttttgtagatcaatatgagctgtctgcaacaataattctctgagcatcacttgccccacgatctcctagccatatctatctcgcttagcattttcatatcatttctgctacagcatttcaccaacaactaccgggatatttttaagaatatgagataagatttggtgaagagcatggatttatctgatattctatatagtaggtagtcttcttgtgactagcatgttctttgtataagaatgggatgtacagttagcacggggattattctacatggccaatcattctttgtctgctagttcactagcaggggtggatctacaccccgggccacccagcccgtggcctggggcttgatc

SEQ ID NO: 5166 - DNA, 1776 bp, Zea mays
  misc_feature (1)..(100): optimal_loci_124736_G1, chr3:199256789..199258564, Cluster 32
cgatataaagatgagccatcaagatggtcagccggacgggaagtatggcaagcgtgcgagtccggctgcgatggagccgggagaaccaccggatatgtgcgaacctgaagcggcaaacgtgcgagtctggctgcgactgcgatggagctaggagaaccacatgagaggcatagtacgtgcatggcagagctatagtttttgccaaaatatctgtgagtcatggctaaaaaaaagctgctatgagatccgcggtgtgaaaaaagtcaaaggtttttttttattgagcagcccagccgtgactttttaggaaaactgattgagtggccgatgcaatcgcagtaatcgcatcgtgcagcgcaggcaagtctacgtgcctgacggtgcacgcattaccagtagctaggcgacgtgacccttttcaggctaccaccagcgtactccctcgtccaaaaaaataagtatacttccgtaatttgagttaataaatcaatattagtatatatattgtatttataagaaaagaagtaaaaaacaactagaatttagacggttacattcctagatgtatacttttttaagataaaattttaagctctatgcgtgtatttattatagaactaagaaagtatgtactcctcagtccataaagaatgcaatttgagcacaatctcatattttagcataaaatttaaccaattataaataaaaaagtcgatatttacaacattaaataaatactattagattagttacaaaatacatttcatagtaaaattaatttagagttatagatataaatattattttgtttctaaaattttgaccaaatgtaaatggtacggacctacattaactttttttgacagagaaggagtacacgcttcatgtaccgtacggtgaatgacagcacgggtgcacggtgctggccactggagctgcatgttcgccacgatccgcagtgctgaattaaaggtgcaccatgtacctcccgttgcagttgttgtatgtgctttaatattagtagcacgtttaggttttgagtttggtccagtgttaagatttattttggttggcagaccataaaatagtgttaggatgttacttaagatcacttctagtaaaaaattatataacattatttctaatataggataaaataaaacatagatgaagcacctacatttaatacaatgttttattgtctgtatcatagacaatttaatgactcgtgaagaattattaatcacgccaaaggagataaaactcacttttgatctctctttttaaaaacatgatcatatctttaaaaaaccatctatatgggagcctattaaatacaaatgaaatttaaatagaactccaataagactagtcattaggaaagaaatgtacctgcttattcatagggcaaaggagcattttcagaatgttgtgccatcttggttagatagctagggcgtgtaactttttcctctcttttctctccaccattctccttcttataaaatgtctaaacaacatttttcattcattaatctatccagtaggggagtccacaccccctcctgttaccataaaaatatatacgaccggacttattatcaatctaatggcattggtcgttggtctagattgaggtgcaatgttataggtttgcactattaagatccaaaagtttctcgacttgtaagtttaaatttttccaacttaatatcaatcatagatgtcctaattaaccgccctgcccgacctcttcggggcttcagactcaataaa

SEQ ID NO: 5167 - DNA, 2276 bp, Zea mays
  misc_feature (1)..(100): optimal_loci_127873_G1, chr3:214647707..214649982, Cluster 32
aaagagctacaaaaattgatggctctagtgctataggtaagtcaaccaacaaaggaggagctcgagtgatatgagtgatggacattagactagcggggcaacctggtatagactctatagccctaaagtacacaagactgtatagatggaactactggagtttgtagggcagctggatgagccatttgtactggctacggtggcattgctactctggtttgctataggaagtgctagaaaatgcaaagttataggcaagatctgctagcaactgttgttgaaactgaccctaacatgtagcttggcgacactgtcttatctgtgcttgacctcacatcatagctgatcaaccaacatttttcgctgctctctaggtaaccattgttgctttggtacaatttgttgttgttgttgtgtgatcatatgctctaacaaagttgtcatcccattgttggttgttatcgacactggaggaggtggtgttgtgctagatccactagcctagagttatggagccttggtggatgtgctagaggtcaaggtactagcacattgtagtccacgtcagagttttcatcggtggtatagtgatgttcaaataattgttgacctcccatatcgcctcattatgctcctggactcccctcaaacctaacaaggtaagatgatcattgttcctagttctaccctatttagggaggtcatccctcaaataaaatcatcaaatcctctttcattttactatacaaggaccgataaattattttgattattcatgaggcccaagagccaaattatatttcactcaaaaatgacatctttgacttctacttcaaagaagctttgtgtgatgatttcattttctatttttgtcacgagtggaatgtaatctatatgatcctcatagattattataaaatggggctcatgaaaaataaatatatttgtataaagtatttggtgataaacacttttaaattaggatcatagtgaattgtgtcttcctctttatcctttagccactaattgtaaatatttcgtatttgcatctttttcaaaaatatttaacctttgctctttggtagtattttacccctccctcctcctaagttgagccaaccttttgtttagtgcatgctttagatttagcttgacttcttttagttgtacaaattcagctttttgtctcggtcatccaatgtatcctgcaccagcattttctctttcttgcatgaactaataatatttttgacccaactccttaagtattggtgaagatgtctaattttagcatacaacattctgagtgtgtgtgtgtgttgtccctcttgcactttgatccatacctctccctgaccatttgaaaaaacccttccttgaatagctaattgaacatataatataagtgaggatatcctatgttttggcacaaaatataatttcttgtgtccattctcatagacacgtcatcttgaacttgtttttggatgatgcagtattaagaaacagtgttgtttagaaaaaaaattgttttggaactaaattttactatgtttttaatatttttagctcatattaactagcaagtttactctatttttagtgtatccttaatttacagagtaaatataatgagaaacttttagcaaattttatattaaggtggaataaaacgaaaagaaacaaaactataattttatagccatcacatgactttagaggaagatcaataataagaaccaactactttgattataagtcaaagtcaagctataagagttcttctcttctatttattctatttttttaattattactatgtggcaccatgtctgttattctgttttctgtttttttttctcgcatataattatatccgggtcgaccactgcagagactctcgtgtccaacttgctgcttgtttgcttttcccccccttctctttcatagtataaacaaaagttattgattagtttggctataagttaattgtcacagtttctcttatcactagcctcgcaaaaaactttgagatttgcagtgtcccatgagtcaaaggatgaaaggaccatagatcataggtgaatgctcttgaattggtaggctgacacgtagagcagcagtaatgctggcccagactctcgaggcggtagcccggtcctcgaatggcgccaattgctgcaaatggaaccggaaagggaagagagatctaaccaagggcaccaccatagagttatccagcggcatgaggctatccgcaattatgttctctaatt

SEQ ID NO: 5168 - DNA, 1854 bp, Zea mays
  misc_feature (1)..(100): optimal_loci_128823_G1, chr3:219486370..219488223, Cluster 32
cctgcagggcgagcgaggtacctgccgtcgcgtccaaacgaacatccagaacgcgacgccgacgccgacgccgacgatccttggaccgtgcctcgtgctcgtcgcatacagtttttttttgttccgtgtctctcggcctacggaaacgactgtgctgcctcattgttctcttctcacatatagatagaaactacaatacacctgttcgtctgtgtccaagtccaatcttgtacgagatacgtactactatagctaaccaaccagccaaccgtttttttttttttgtatttcagcggttctgttctcttgtaccgacgatgacggcgacacgatgagcaaagcaattcaccggtacggtacaggagagccaatgctagcgctgtgcatggagccatgcatggaggaagttgtattccagctttcacgcctcacgttctgcccccatgaatcctgaattccctgagcttccttctcccagatttttctttttctaaataaaaagaaagaaaactgcagacgcattcggccaacaaggggggcccgtctgtccttttcgtgacacggaccgtgcctatatccgggctcataattcgcgccatgacccgccctttttattataaaaaaacagaaaccataggcgattagaatttgagcatcaacatgctttattttattttactacgactacgacgagctagcctctagctcttctcggagcgtgtgcagaactgtgtctgtgtgcaatgactgctgacgtgtactcgtgtcttctacaacgccaagcaattactcctaatgattgttgttcgtgtggatcttcctttttggtagtcgtcttgctgcgttgggaaaaaggctgaggctgggacgatcatcatcataatatatctaatcttcatctggccggatcgatgccaaagcacctgcatgagagctagaaataaagccagatcaatataatagcgtaagagattcgacatatgaattttagaggaaaactgacataagattggattttcccctctgtgtctatataaagggaaatatgtgctgacggcggcaccaaataattacataaatagaatttgaaagtcactagctaaacgaaagcccccctccccccgacgacatgactaaactaccgtcatgtcttgtcgttgcccagatgtcgatgcagatgcaccctacgtacgtgatgacatggcacacggtaattgtttatatatgcttgtcggggtgtgcttgattggccgtgtgccgctcatgctagatgcaccaagcaagttagctaggctccgattctccatgcacgctccccccaaccaaatctctacgttcgtactttctattcatataaaaatacctgcctcgctcgcaagtattctctcctattcagctctacttttatactttaaatgcactatttaatttttatacaacatttttttgatttttatataacaaaatttaaatgtattatttaaattagtttaagttacacactaatccacttcaatatatacggattgagcttaatattagagtacctcaactaggtctagggtttttttctgcaagactgagaagagggggagtgagtgagtgaatgaatgggaggtgaactattcagggaatcgttggagaacgcgtgatcacgaggacccgaggagcggaatgaaggaggaaaccagaaaaacataaatagaagagataaaaattttaagcgtgggagatgaagtggcacatgcatggcatatccggccccttgacgcttgtccggattcgaccccctagtagtagtagtagtagaataaaaccacagcaggcagcagacagcgacgacccaccgctttg

SEQ ID NO: 5169 - DNA, 1768 bp, Zea mays
  misc_feature (1)..(100): optimal_loci_130824_G1, chr3:229596781..229598548, Cluster 32
ctcgacccttcaatagataatgggtataaccgtacaagtatgtaatccaatcgtaccttttaaacttggacttcgactaaggaccttgtattcgtttatactgcactaaccagtcataccaaactatgcttggctaacctctgtaatatatcatttgatgatatactattttatttcaatttctcaccatgtgtgcatgtcttgagagtatccttcgtaggaacatgactcaattaaggtaacaatgacaccttaaccaacttatattgctgagtgttttttgctcttgtgatttaccttttcacaaacttgaccaaacattcacctttcaagttattttttttaaattaacattcgcgtacaacttgccaccaatttgagtaagaaagttatcacaaccttcaccacaacaaaagcatgacccaaaggctatacatgcttggccctgaccaggtaacttaatttttattttattttattaaatccctttttcttactaacatgcatgtcaccacaccacgagtatctcttaactcctcgagctaaccctcccatataatatattttccttattatatgcatgttgtcaccttatcaactcaaataagttagcactccatcaaatagtggtttccattaagtgtcaaccctcatcacatatctgtccaatggctctagagttcgcatcagttagtactctccatcaatcagtggttctcatgaagtattcaaccttcgttagaaatttcaacgatcctctactagtaaatgctttcaccagtcaatggcctttgttaatcaatggccttcatcagttaatgatctacactagtcaatagatctcatcacttagtggtcatcatctataattgtttatcttcagtcagtagcctttgttagtcagtggccttcatcaatcaatggatttcaccattcattagttttcatttatcaacaacctttgttagtcactggtcttcaccgatgagttgacttcattagttagtggtgttcgtcaatcactaattttcattagttagtgccctttgttagttagtggatctcactcgctagtaggtctcattagctaatgttttttaatcactctatggtttttttcattagtcagtggtcttcatggaacatctatgaaccctatagcactaacattattcctttttataggttgtattgttaaatttccctttttaggttttataatatgtatcaatccaatgttatttgagctaatctttgcatgaaactaatcgtacaagctcctaaatggcagacttttgtagctattcaaaaatataaccctctcattcgagggcattattccatatgagcaatcatgcagagcttatcttttgttaaagcataactatcatttttgcagggtgcatgataagtttagcctatttaatattttcatgcaaatgcactcattagcataaccacacaccacggtaacccgacaaagaactacatgcattaatgcatcaggaccatcaatctcaaaaaaagtttcaaaaatcttgagaggctcgctaaaagcttcaaaaatctttacctaataaagacctatccataattaggtatcgatgccttcattctaaaaagcttaaaaacttcacctgacaaagacctacccacaataggcatcaagactcatgaaatgactaaccatcctttgcaacaagtagaaagctaaggtttttctaagtgcccacatcacttcactcctttatccttcttagtctccatc

SEQ ID NO: 5170 - DNA, 1716 bp, Zea mays
  misc_feature (1)..(100): optimal_loci_131035_G1, chr3:230970738..230972453, Cluster 32
tggcgttttagttctggttgctggttcagtattaaataccatagctagttctcagcggatacctggtgacaagttctagtagtgttaagaactatatttatgctaataatgttatgtatgatcaatttaaacattcagaaagattttaatggtcatttgtcaaagctaaaaactatcttttacagtactcaagaaagcatgcagcagttgatgtggttcgttgacacaacgcagtcccatgtatgcttggtttccttcctagctgtttgaacaagcgacagctagtaatggattattgaattgtctttcagattctgttggacatagtactcaaagctgtatagattaattaattgcgacgacaagcatgaattatatatcgtcagatttctggtggaattcgttgaaaccattgcccacaaactgacaacattaaaaccatgctcgtgcatttcgtcggctaggtttccttactacgtaccctctgcggcttgtacaaacgatagatatgttgtacttgtatgtttcagtctgattaaaaatcttattattgtttaaatatagataagattatgaattgtctcttatgagttgtctttttaattgcactagttggatgtctagaactgttgcctcaaattaaaattcatgcattagaaaagcaaatctcgtacgtatagtatatatcatattgaattgtctttcaggttttcagttgttggaaccttatttgagtattaatctaatttaagaagggtttcgcgctttaaagcatgaatttcaaagttgtatagtgatttaatttttgtcctgtactctcagcagcagcagtatagattactgccaacacaaatcttttggtatttgtagcgataatttgcgtatgtttttggtacagatagtgctggctaataaagaacaaggacttggggtttgtagaaagttggcaacgagcttgttgcaatctctcattcagagatgacaccaaaaggtgcgtgcttttaattgagacgaagaataaaataacgatcctcttttttgcgctttagatctccgaatcgacattgccatgtatctggatgcaatggggccgggtgtggaaaaagcttaattaggcagcaggatgaaagcagacgataagcatctctctcccctgcagggtcattagtttggcgctttggaatcatatatacaattaataaagatatttaatcgatctcgtctcgcccaacatctgatgatatttaaaatatgcttgtcgtttcgttcgtagataaaaattgacggcatgcatatgtgttgaaatctctttctccccatgactgtctattctttccacgagctatgtaatctctgtgtggttgattgcgtgtgcttttgtgtgtttaatttacgtctgccttttgccctatctcaaaagaggagaagccccatactactttcttcttaaaagatgtattgctggctcttttttttttttttacagatttacattcaaagagtttggcgttgccatgttagtggttagcaaaatccaaccataccaagaaaatctaaccctacccaattgacacatgtaacatgcaagaagctagctatccacataattcccttgatctcactcattagcctgaggtggcacccggtcaacaggccgacaccaactccttccctcttccaatctcttggaattcacacacccacggacccacccac

SEQ ID NO: 5171 - DNA, 2036 bp, Zea mays
  misc_feature (1)..(100): optimal_loci_131459_G1, chr4:1266570..1268605, Cluster 32
gataagtgctctgcacttgagacctttttagccagctacttgttgaaactgctcctgcaaataagtaaggtaagattttgttctaattgagcaataaggtagtgcatagaccacaaagacccaactattgctgctctcttttactccacggcatacaacttggagaaaagctttgatacggataagaattcaaagtttctttcctttctcttctgttaagttaaatagtgcaagatgcaaaaaggaaaaggacacatgtaggggctacctacgtctacatatatattgaattcacaaatggacaactcagcaaaagacatcacatcaagtaagccgaagcaaagcagagtagcggattatggccatggtgttttacttatctaacaacagccattataaacaagaaaaattacactttgtgatgcaattatgattcttttagatcagggaggaaaccaaagtaccagaaggtcacaagactgatgcgaaaaaagtgtattatgtatgcccatttagaaactaagaacttattatgcagcatgttacattttgaaaagaactattaacttgccatgtatccttatacaggtgtattagcaaactcaaaaaccaatgaggaaactgagacaaggcaaactattatcaataaataatccaaaatcagctacgttgtccatggcaatgaacacgagcaagagtcccgaataagaaataaaacacaggaagcgtccctgaatatcaaggctacaacaaccagaagggacatcaccatgtaaattgtgcaaaggaacttgagtcctgccacggtaacgggctgaacatgtcaaactgatgctacagagtagtgcagtagatacaccagatacttcgacaacccactgtcagcacacactatctgaaacaaaaatcaaatggagcataccaaacatgtggttggttaatcttgtaatcaatctctcaaactttgactcatcaagcaaaagttgttatcttgttccctaatacctaaaatagtttggtaagcatttgcagatactaatagcttaatgaaccaaagaaagttctgtgacgtcaagatacaaagatctggatggggtgggttaggcgaaacttatagaatcaagaatgtgctccatttatctctagatatcatttattaaaaggaggaaaattatatgtgacctcggaaatacttacactagatctctaaagttcactcagtatgcactacatagattcattgtgtctgcatgcgtgttcacagccaaaacttaactcaaagaataaagagggccaaatggaaaattggccatggtaccacatgtttggcgtcatatactagtcgcctctccactaagcaccttgcgagggaattcatgctacattatgcatgaccaaacggcctaacatatgcagcaaaaaaatttggcaaggcattggaatgctggtcactggtcccgtagcagaacctaagcagaaacactatcacgcatttgatctgtttgttattaagtaaacctcctgcctccctccacttcataccacacctttacattgtcctgaaaattagtctacctccaagtgcagtgtaagagaaacaaacgcaccggtttctggatccgcacaatgaccgtgattgcaaaagagactccaatcaatcaagaagtaagacacgtgataagaaaaatgtattaccggaatggaaatggaggcggctaggaccatagaccatgtccaccagattgaacaaatgaatccccttttttcataactagcaatacccaggtacccttcattaaaaaaaaaaactcaggccctcccacaaagaaaggggaagaacaaagatttcccccaattcacattctttctttccgtcacactcacctatcggtcccacactgccgatccgggtgagcggccgcgcgccgggctgcattcgccccaggccgcggcgggagaaccgccgctttcgcgccattatcctgcaacggcggcggcggcggggaggaccactaatttagtccctcatttttcat

SEQ ID NO: 5172 - DNA, 2593 bp, Zea mays
  misc_feature (1)..(100): optimal_loci_132055_G1, chr4:3509312..3511904, Cluster 32
atgtactacccgagctaccccttgatcacataataaggcattgatctctatacacagatttaaataaaaatgagacggttgtgcctcatcagataactccctagtatgtgcccctagtaattacaacatagtgtgaatataactagtttcaaaatgatttgagacatttcaacaaaagtgggtttcttttgtcaaagatacctaattaatgaatgttggtcataaggactacacacatatgattctcatatgcgccattgtgaacagtgaatataaacggatccaccctaaattaaaggttgtgatttagagttatttgcttgctgaatgacctcgctaatgttggccatagacaagtctaggtatgatttctctctatgctattgtgacgattgaatataattgggtctaagaagaatgtaatgatgtgaattaaagtgtacttgttgaattacctcataaatattgttcctcataggtaaggatgaggtaagattccccttttcaccccctagtctaggtatgatttctctctatgctattgttgaattaaagtgtacttgttgaattacctcatgacctcgctaatgttggccataaatattgttcctcataaatattgttcaccaatattgccaaactgagcacttcaaagttaaaatctctaatgccattatcatagattcattaaagaaagtaataatccattattgtataaaggtcagttagatccatgcatttataattaagaattaggctgacactatcaagtagctaccatgaccatagctacgatacaaagactaattagttctacacttagttgaactgctttgtcaaaatttaatggacccttgtttgtagcaaataagttgcacccctaattaatctttatgagatcaagatcaatgtccatgagttggtaatcttgcataacatattggttggcctctattgtatccattgtaatatctatctcatatatagcattctcctctacatccttgcccacatccattggtacactacaatattctaggtcaacagttcttaccctaagcactgatttggtgaatcaatgtgaacattaagaaacacaagttgaattcatgaagataaagggccaccaactctaaaactagattaactgttttcatctatagatccaagaatagtactaagctaaggttagtgtcttctagaaccaagaaacatggtgcgaatatatacaaactaagatgtaattagcattaaccattgtttgaatacaacattgatcatgtgttgtagatttatctatcggtgaggaggaagatgatgggcagagacaagcagagatggtcactttagcctgccaccatcatgttgtggcaaataagagaatggacgagagagaggtgtggtatgtagggaatgtaaatagagttccacaacatatttttgcttgtaacaggccccataatgtagggatgaatcttgctaatgttaggtagacatattgatgaatctcactagctagagcatgattattaatgtatgagactgggctaatcaccacatgaaccactgtatttagttcaacaattctgacatgcttaagtttgacacgtttctgctccacataactatttttgtagcataaatgatgatactgattatgacacatcaatagttcaacaactcaaccaaaagtaaagataccctgacacacacttggttctattttagcgagttgaggatctatccaattaacatgcaaagaactaagaaaactataaataggtaaccacaatttgttttcatataccaattctttcttcaactttcttgaacctctgttcatgtctttaatctttgtcatctctttgacctccaacatgcctttgtcaaatgatacaaaattgaactcttcctttgctctaacaggcacattcacctttagatacaacatctaatcacatccatcttttatttaagtcttaaaattttccacatttaggagcaaatcactcatcacaaatcttgtgggtttctaaaaagcaaattcttaaatagagcacacctctaagatatccataaccaatacccaataaaaagtaaaaaataaatcatgttgtccatgctctattgcatctatgatagccatgacctaggttcatatcactcaaagaaaaaatagatccacctttagttcatagttgcacttagttgtgggctggtatgcataggggtcatcatcatatgggacaagtggtccctcgtgttgaatccttctctgtcagaagagtgggtccttctcatgagcctgtcctttgatgttgtaaaaccagatgacgagtgtgagctagattccaccatgtacaactctagatttaatcttctagactctaagatcacatcaaatctttctccaagctagaacatgtttgttccttctaaagtttttattgttccctcaaaacatagctataaagttaggttctttgttgggtcaaggcatatttttattgcaaaatagcctaaaatgggtaggagtaagtttcttggttgaggttgtacaaagcagccataaaatatactggccgacaactgg

SEQ ID NO: 5173 - DNA, 1782 bp, Zea mays
  misc_feature (1)..(100): optimal_loci_132208_G1, chr4:4201770..4203551, Cluster 32
ctccgttgagcaatatcatttcattatgcattgttttcacgtgcatttccttctaaagatcttcatccttcacattaacaactaaggacaaaagtccatactcctaacttgtattgccttaattttcaatgccttcaggagatagaaatcaaatatccaacacctagaacgaaacaaatatggcctaattatggtagaaaaataataacatataaaaggttcctatcaaataggaaagcaacactcgctctctcctaattagtgagaagcaatgcaatattttgtcaagttgcttatcttatctaaaagttactttaattccttatgttttaagatggatggagtattgtttatgttgcccattctccacctaaatagtttttcgtatttcatgtgcctccttccacggggagcaaggttggttttctatagaaaaatggaagggtataagggggagtgtataactaaaaagtgaaataataacaataataaatataaaattaaaaagaaaaagacacatcataaacctttgaaccattggcccttcccttgggatggaagaggattcccaccaccaaattgcgattgcattttttgtttggaacaaaacttgtcacatataacctcattctggtactacaaaaataatttcaagagacattggattgaattgacaaagatgggtgcattagtatattgcctctaagaatgatctaaggtggccaattggcaaattcaaactctataaatcatttttagagtagaccccttaaaacatatacctttagaaataactccacttttagacatccaccaaagaggaccaccttgtaaaagaaatgcatgcccttttagctattaaacccttagaataccacattatgtttcttttttatccagtctcatctccctctcaagaagggaggtcaattaggtatctaatttcaaacataaaaccaagttttttttatagtgcactccatttaactctcactcacaaagagttttacaacctagagttgatccaatcaagtataaccgataaataatttaggaaggtaattaagagagcttctacacatgaggaagaggatctccacattctctaaacactgatatgacaccactccacatcaagagtgtgtggtcatcaccacgaaaaccaccacaactttacttgaaggtcatgaagatgttaagaactctacttcgctaggatacaggcgcaagtcccaatttctcaaaagtctcgagctctatgacccaaatcttatgaaaatgtactctttaaagtttttttatgctagattcagtgcagaaatcatttctcaaacttgtaataactttgtgacactccaacatactcaacattatgatgcaaccacatatatctatgcaccactaggtgatccgttgagttatcctagaatgcagcatctcaagattgaatgtcataaatatgtatttttattataggtcaaaagttttttagcaaatgttggttggaattaaggagaaaccataaattttactttttgatctattgcttggatgggttaagggatttttaaatttgtgtgcctagttcagcaacaatgcccaattttacccctctctagtagtaatggatgaggggtccttactactagagagggcaaaactaagcttttctttttactaatagagagtagcaatcctcgtgtgtgacagaaacaagtagccagagaacaacgagcacagtacagggagaaacacaatcgagctatacacattggtgttctc

SEQ ID NO: 5174 - DNA, 1509 bp, Zea mays
  misc_feature (1)..(100): optimal_loci_136109_G1, chr4:22625708..22627216, Cluster 32
aacagtgacttaaatcagtgtcatatcttaaaataataaatttaactcataaacaacagctccaactatgatggataggttaaaggcatataactatcctcctttgacggaagtatcctagattaataatttgtctcacgtaaggaaaacctgagttagagaaagtgtatcctacctacatgctattaagaatgtaggagaggatggtaatattacaaagttattatgagaggagcttttcaaaatattagaggtctgaataaatcagacatattgcaatgtgtgactgattttgttaaagacaataacttggatttcataggtttacaagacactaagaaagaaaaaatcatatctcctttatacaaatccaagttttaaatgggtgtcccttcctgctaaaggatctgtagggggcattttgttgggtctaaatattaacaagtttgagatggttaactaggaatatggaagctataatttgtctattaggattaaaaatatgagggatagttttgagtggaagttgattgtagtgtatgggtctccataagatgaaagaaaaggggagttcattaatgaactacacattattatggaataatggcaaggttcaactttagttggagaatactttaatttggtaaccaatgccaaggataaaagtaatggcagggtgaaccatcatttatctgacttttttgttattagataaatacgtgtggtatattataatataaaatctcttctaggtctttcacttggtctaacaaccaagaaaaatccaattatggcagccattgataaaatctccgggtatatagaatttgataaaaaagtatccatggccaaaatgaatattggtgccaaatctaggagtgaccatacccacttgctttttgattttgtaattaatggaaatagaaacctaagttgtttaagtttgaaaaatagtggttggagcttccagaattcagagagttggtgtatagaatttgggaaactacctatgtcttggagaatcccatagagatttggcagtttaaaattaggctcttaaggaaaaagttgaaaggttgggattcgaattataatgcagctataataaaacaaaaggcgcttattatggaatatgatagactagacatttggcaagaataaaaaatcttaatcctaatgataaggaaagaatgagaacaaattctgagaacttcaatttatttggtctttaaaatagattaaggcaagacaacgctctagagaaagaaataggaaatgagatagaaatattgttttctttcaagcagtagctaatcaaaggactagaaagaaacatattgttgtattagagggccctaatggccatataacagagacaaaaaacatgttgaatcattccataaatgtttacaagtctttgtttggttatgaagaaaatataggccaaatattttcgaggttaagatccctggcctcaccgaaaacattttgaggccagggatcataacg

SEQ ID NO: 5175 - DNA, 1467 bp, Zea mays
  misc_feature (1)..(100): optimal_loci_145661_G1, chr4:81598790..81600256, Cluster 32
ttaaaacgatcataaagtgtatcagatcaatcttatagtaatgataggttagtttagagtcatgtcttttagtatatattattttcaaagaaaaaaaaacagttcaacaaaaatgtaggcaagtggagcacatgttgcagcaatttgacctcaaattaacttaacagcatatctaagtaatgggatccaaggtctaagttgtcagctacaacctcatgctctctgcatgaatatgctagcacccatttgctaaaatgttcctccttttagctgttcggctgctggctgaacagctgctccacagccatccttcacacatggccagctgcggcagcataagtacagccgaacttctctccaaggacgcaatagagttgtgcgtcattccaataaggaaaatgcaaaagagaagcaaaaggcctactcccacacacccacacaatgacacaaaagcttataatttgctgagtgagtattcttagaaactggaggctttggctgtcttaataagcaacaagagaaatgcctagatcaagggaagtactttggccctgaactgtttttttttatcaaaaaccagaaaccgcaggtcagtttaaaatcagcaaatctctcctgttgacaaccatgaatacagcttgtgttctggtaaacaagtgttgccgtcagctccctacaaatttatgcagaagcagggtgtagcaaaaaaaaaaagaacgagagggggcaacaaactgaaaaaaaacactgccatgtgatagcagaggctctgcgttgcaagcagtcaaacaacaacaaagctgccatgcaggtaccttggatgctggtttgatccatagataacgatgattgcagtggaacatctatgttccccttgaatttttttctatgctccaacgtgcttcatgataacacctggtgaaaattgcagggaacaccagttaaaatccaagtactggtccccagacacctaaaactaaaactagtgcagcagcctagaatgtggtgaatgtatccaaagctaaagaattattaagcttctaaaagcttgctatgcactacagcagcagtatagaagaatcggattaatgactactacaagcactttttttcatttctaacccattttgttacctttcctagcttgaccactgcaattcagcataaacaatactgctaccataataacaaagggatcaattgagatgcagaatatggcatccatttaaaatgtgagcaacaaatgtgtacgacagcatggaatcttacttggaagtttcaggttatcacgcacacaacaaaactagggcctccatcttgccatgaagcataaaagagtcccaagttccagaaaatcgccactatccacagcacatatgggggaaaatactgtttcactttcatgtatttatggatcaggagtgaagcatcagggcaaatggctcacatactactcccaagtgaata

SEQ ID NO: 5176 - DNA, 2392 bp, Zea mays
  misc_feature (1)..(100): optimal_loci_145798_G1, chr4:82361512..82363903, Cluster 32
tcaatctatatatattgcacggtgttcatatgtgtatgggacgccatgctttgtccttttcacatacattttaaatgtctcaggagtcaaggacatgtctacactgatatacacagcacatcagtatcacatgctcttcactctgttgtttcacccattcagaaagatgagtctaaaaattgttttccagaaataatcaatgtagttattctttactccaattaactatagcactatatatagttgggcttcatcaagatcaaatatttccgttataggcttatagctaacagagaatattgccaacttctaactgaaactaactgaataatgggaacatattattcactacccttcagcaaacaaaagtagtaatcctccgaaccatgatcatgttaagttgacctgtctatgagcgagaaattaagcatggcgattcagaattcggactagtcaattggtatgccagatgcaaaagaatagatgggagagggaaatagtactgtttgattgacagcaagtaaagaagaagttgtgcggtcaatcattgaacgtacggcatgtaggaacttgcatatgaaggagaacacacgtggggtacggtatacatgcttgcccaagcttatatatactgcactgccaattttagtccatcagtatacacctagacaagaattacttgattatttgtaccacctgttgagtgaactaaaagtatgtgatgatactaatacacaagcatctacatttctttaaaggttttctaatagttgattatttgtgctagcaggggtaaaagactgaaactaaaattgcccaaaacaatcaaaccacgagctcgaagctaagttttgcaactagactatgtaaaaaaactctactagaaggttttgtggcaatacatgtctgcattgaaatttgatgttggaacagcattgatttgttctgtcgtcacatatgttatctagaagcatgcatatatgcaagctcaagcatatgtacgctggtgggaagccaaaattcagatatacctctcccacttcatttattttacactcagatcatatatagtctctactattgaaagcgctctagttaaaaatgacgaggacaaataaccgcagacatatttgcattattaaaaaagaacaactcagctagaatataatgatgaggttctggcatattattattgatgagcagttttaatagtcaaagccatccagagccgaagcacataagccaaatctagattattaatttgaagaactctggtataataatataatgtatgattgatgtggcttagttttatatgtgtatgctcttgtttcctgtttctattgtacaaaaggatacttttttgtacaatcatgtcttgtcatgcatgttgatttatggaaggtgttatctatatacttgttattcattaatcttggaggataaaaatattgattgtttcatgtacttaactgtgtgttatcatatttcttttctgcatagtatatatgcatactcttttttgattgatttacaacatgtttccatcatctagcatggcattttttttgaacaattcaaacaacaacatgtatctatatatacagattcctaataaatgatattcattctgatcatgctatgaattagtttgaagctgagatccacataaatatataaaataacggaaaacaattcagagttattctgagaagaagttgttgtgtacatacttgaacataaacaattgattcaaatataatttttccttatgcagtccaaaatatttgatttaagaaattaacataaccttcttgtttggtatgatttatgggatgccgatattattttgttgaaattattgtttttaaaggtcgaattaagcactcttcagactaactaatcaagataattaatgacatatttatctgcttcatatatgtttataatataatgataccatgcatattacctctctctcttcaagctgatatcactaacaacagagaatggtatgtgtcctgctgtaatgttaagagatttggtggacttgaactgttgtcatgcaataaggatatttttaacaattcccaacagtcatgacgatgtaatctatccaagaatttattcaaaccgacatctataagagaaataatttaagctatctatacttatcataaatctagtataatataatatgttcatgggacatgaatttgatcggttggtcatatgcatttttatgctctgcaagagtgtagaacacaacataaactgggtcggatctggaagactaattgtaatggtcaatacaattggtttggatctggaagcgtaattgtaatcattatcgttgcacacatcgtttttttaaatgtttattgtagttcat

SEQ ID NO: 5177 - DNA, 1880 bp, Zea mays
  misc_feature (1)..(100): optimal_loci_160138_G1, chr4:175985783..175987662, Cluster 32
ttggtaatcccataacaggattgacaatcatgatacatcgataactggtgtgttaggtagaagctttcaacgaaaggacggtcataagcccaatggaccttaggatcgatgtcacattcttggtgtgtctagcttttgtgttcgattcctagatctacacggtggatgacttcagcaaattccatggtcgccttatggaaacgatcataaaccaaacatccctaactcttcctatgacatgttggacggtcttgttgataactttggccaattttcattctcttgcataaactggatggagagtcaactaaatctttgtaactcctactcatgtacgaccaaacttttcgagatgacttccccaacatcaaacaactacggttcaagtctagtcagactcactttcgcacttaagggtatcgcttcatcttaccaaaaaatgttatggtctattgatgcatgaaccacaccactgaatatatcgatacagaaaggtgacaactcttactactcagacacaacgtgcgaagtcggtaacgaatttcatattctatacgagaatgggttccacataattgataactagtcgaaatcagcttcgattagtcatattcatcaacaacctcctactcaggtacaacaagtaagttgatgctcgagggctcccaaatccaaagacaccaggtatgtatcatggttcttcaacccaaccacgaaccaagctaagatgctttcacaagtattctatttgtgccatttccgtcttatttttggctaagttggtcttcaatgagcagaaagtcacaggctaatgcacataacaatcacactctggtgcatgtatgccttttatttataatttaagtatctatgcgatacattttatgtttgaagccttgttcgcaacaacaaattccgatataatccaatgctatatgggccacgccttcacatgcctaacatcctacacacgatggaatgctctagataacaaggtgtgtagcatgacaagcaattcataagggcgaaacaacaacaaggataaaagcaacaaccttacaatccacttcaaatacttttatgacacaagttatgcacaacgagctttatttgtgatgatgacctacatcatgaacccaatgctacatgggtcacattgtcacgccgctgacagctaacatcctacacatgggggtatgttttagtcaacaaagtgcataacacaatgaacaactcatagagagaaattaacatatggtttatcatgtccttatgttattttgtaatattataagtactcactgatattgtcctcgtgacctaggatgtacatcaacaagttgagctacctacaaccattcaagtacgccctcaacatgttatctcaagctaaacgtgtcatcctcaacaacattgctaataacaatcgtcgagtgcaccctcaacaagatacctcaaggtggatggtcaagtaccacaacatcacgacaccagctaagtgctcacatcgtcctaagtaccacattggttatacaaaactcgagtacttataccgattaagtacaacactgacatgacatgagttgagtactcacaaggctagggccatagctaaaacagtgggagccaaatacaagtggttgagtatagcgatgtcacaacactaaccaattattcacatcgacatagtttcacattggctagacaagtcagtactcacacaatgtggtgtcaagatgccagtagagtacgagcacacattagaactcaagcatctatgcttcacaaaaactattgtaacatcagtgtgtgatttaattggtatttaactattgttccacaatggttctaaggtaaaggcacaatctgattttgcgcga

SEQ ID NO: 5178 - DNA, 1756 bp, Zea mays
  misc_feature (1)..(100): optimal_loci_162305_G1, chr4:189109561..189111316, Cluster 32
actagtagctctctgctatgagggcatctcagtggatccatagtcccatagcgtaggctatgaagacgtctattgaactttgtaaacccaagtttctctccgacaatgctaacataaagtctatgtggcctacctttgaaggtaaactagaagtattcatagttaggatcgatccaaacaaaggcatacaactctctaacccataacatacaggctagatcgtcctaacagacttgccaatcctggcaggtaagtaggtcgaaacgaatctactctccttcaacaacaaaatgtcctctgtgggtcataccctatgaggcataatggttattcggctatgagtcatggctgggtgaaaatcctcatgaagtagaatatagaagccatctaacattatagggtccctctcatctagaaaccactactcaagtgccataaaaagcatagctcctaaacttgagaagcactagctatcttaggttaaggtgaataacaatcaggtggtatggacctatagttgttgggtgtgttagtggtatatgagccggtcttagctccttaggttgtggtgtgactagtactcgagcacgagtggatctatggatggtcgactacttttttgtctcccgctattgatttttctgtagttgtggttgcaccaatgtaacctcaataatatgaatgatcccactcctaccacctcaccctatggccctgttgcttaggcaacatctagggctctctaagcctctttgttcgctagcttgtacttataagcactcttagcatgaactgccttgcacttgtctcaggtagaacagggtggtggccatctgtgatggttattgtcacccagaccacctccaacattcttagtgtaagccatctactatgtgaacagaaacacaaaacccactaactgatagtcccttgagactactaatttctcagaattatgaacctttagaggttggccctcaatccatatctagaggcttggtctcatgtttaatgctcagatataactgtcacatacttccttgactgattgacatgctatggaaaataagagtgagagggtgatagataccttagagattgacaacaatgaggaggaagagaactctgatcaagaggccatgcgataagcaaagatgcgagattgcaagaaatagtagggaatcagatcaaagaagggttcttggttggtggagacatttcatcaaacacttggagtgtatagaagttcacacctaagtaaatgatgtttgtaaggagatgaacgaaggtggaaaagacctgctaattggggagagggtctggtaggtctgtcggtgaggtttggtcgatgctgactcagtggtgagatttgttggcactgactcggtggtgagatttgttggcactgactcaatggtgagctgggttagtgttgactcaatggtgagcttggtcaacacaggcataaggtggagctagggtatctgatgagcagtagagtacgtgcagctataggcatagtgatgcaagcatgggtgaaaggtcatgggcatagtgcaagcttgtcaatggcatgtcacagtggagtgggtgtgtaaggagatgcatcatgatggagaggaagagactatgagtgagagagaagatggttgtgagaaaagagagtgagcatgaccttgcaacttagggaaagaaaagagtgcttccaagccctaatcaggtcattagactaatgtcatactttagaccaatgggt

SEQ ID NO: 5179 - DNA, 1590 bp, Zea mays
  misc_feature (1)..(100): optimal_loci_162512_G1, chr4:189811524..189813113, Cluster 32
tcataaccttgaggaggcagtggcttcttggaaagcaaggaaatcaagtggttgattgcctgatggatgtatcatgggcattttgttggtccagtcttagttggcccccctgtgtgtgccagttcgtgggtcgcctctgctacgcatttttccagggggaccatctcttatatctgctgcatcctcatcttggtagctttcaatctcgtgatggttacttctagtgccccaccatcatggcatttccatgtgtattctttctttggtagccccatgttttgcatccatgcagcgattctgcaatgaaactgctaggttgaacatcaaaaggtaaaagttgaagatttctatgaatatcttacatggatgacgtgattaaactgtactttgtagttgggaccctttgatatatttttttcttttcctcggtatgtgttaagtaggttgggtctactttatcattatggcagtcacatgacccatttgcgctgatgttaagataaacaacttggtgttcaaaagtcttaatcatgtaaccctgggatagggctcaactttcgccactaaggaaagaaccctggcacatggcttgtgctctagacttcttagtaagcagacaggaaatcttgtcgttgatacggtagttaacctacttgtttaatcatcattaccgcagttgccacaaaatcccattcagatgaatctgaaacctgcgcagtcatctttccattaatcaatctaatgctctgggaccatgtttctctgttctgtatctatatgtagcaaatgaatacctagctctcaggatacttacagtatcccgtggtctttaagctaagaactaacaagtccttgctactgagctacatggaacacttttttgttaagcatattatagacacatcatgcatatatttgtctctatctttgatgtgtttcacaaaccgaagctacagtaacccctttggcttattaccctcggttaagaactaatgtttcgcaagttgattctcctctaggtgtatacttcattttattgactggctgtctaagtaataaactgttgttaggcccgtaccagctatttttttgccccttctttgcataggcaacaaaagcaggagacagccctctgtttttcttttgatacatgctgtgaggaatcttcatgcttattggagttttgcggccttttgtgtcgaaccttgccccttagaccatcaacttaggcagcctttttcttagtatcctactagggcaattgatcccacttgcacacttaaacttttgttgcacctttccttccccagggaacaaaaaggtggagaccggctttaaaagattaggacatgaaaatccccaggtgtcagcatcgcttatgcggtatgcccccatcatttcattaaaattgaaggtttgtgattttaccatgtaaaataccagtttaccactatgtctacgtattccttatatgccattattttagggtcatttcattttcttcctttgattatgcttctctcattgctcccttagccacccaaaaagttataagcacaatactttcgttccatttattgtgatagttcc

SEQ ID NO: 5180 - DNA, 2062 bp, Zea mays
  misc_feature (1)..(100): optimal_loci_164120_G1, chr4:197812707..197814768, Cluster 32
cccattgcccagcactgcactgcaatctatatacatttcatgtatggcttcttgtaaacagcacgctgaacaaacaagagcaagcaggtctccgtgacactcttgaaaagggcaggcaggcatagaaaatcgacatgaccggccttgtgctccaaagtgcatgacaaaccactcttttcttggaagtttttatagggaaagaaagaaagaaacatggagtagtgcctcctgaactaccatggtggcagtccacatcctgcgggtagaaagcgtgctggtgatctccatgagattcaatttggggatcccatttaatctccgaccgtgttcagagatgatcatcaaccagatcgaggtcttttccgatgcggatcaggtcgaagtttggatatgtgctccgcgtagcaattgcattatgagattgcccgtgcaaaattatgaattatgatgggctcctaacccgctttgcggctaatcatcagttgcattaccacgtggagaacagaaaaggagtcaaaataattagttgagatgtgtgtgcggtttgatccttaaactttggcttttcactcgtatctcatggcccagagccagatcccttgctttgtcctgctgcgtggttgtattgtatgtggagctcctaaatctccaaaagtaccatgtccaaattgaagcattattgttttcaggcaaagttaaaatgttatgtacagcaatttaatttttcctagatattccattgaagttccattagtttgagctcagcctgttcttgtcgtgtcctgacaaaaaattgaagcttgggaaccatgacatagactgaggcagacagaacaccccaacctcagcaatttggggcagtagttgccaggccagaaaccttgggttgctgtctcttctctctactccctagtatccctttaggtatagcactttggaagcaagaagtgactgagaaacctttaactttctgcagctacctttagctgttgcattttattagtagtagaatgtagtaaatagtaatctacccatatatacagaagctttttgattgagtgtcatctttacagaagtcaccaggggtaaatcagtaaatgctagtcactagcaaatctgtctgtacaatttttatcagttagctctaccattttaggtgtattaacttgcaaaacaagaggttcgcctccatcagccacagtagtttatactgaaatttatatactgccacaacagcggtgctcggcgcaactgaaattgacagcgtctgtaaatatctagtaatgcaccttctgacatcagtagtactgctcggcaaagaacacgttggaagaagcgtctaatgacaggggtaattaaatgtcaatccttctttcatcattgtttaacctttctgcagcttctttgcagcagaatgttctgaactgacaagaggccacatttggtaaatgtaatacccaccatcatagcctgcttttttatcactgtacgtacctgcaggaactcatcagctggatctatctacctatcgatccaagtacacaaaacagtttggttggccatgttctgtgaaattttttaaattactacaagatcaggtcagatcagatcttggcagcaagcagggctggaaaatgctctggtgtcagggaactaacggaagaatgagatgtaaaagaacatgcatcacagctagagcaaggtacaagtttcaacttatttaaactagcgataagtcctcccttacaacttaaccatgtgtacccccatgttgtgatcacaacacatcaccactactccactaggccacagcaccttgatgggatctaaatccaaagccctctctgcattcccatgatgcttccatctctattacttaaaccttgtgagtgacacctaacatgtcccctaaactgtttgccgtcgctcacgcggtctcattttttttttcgtgcacttgtggtctgtctgttggatgacattgacttggtacatactactactactaacacaaagctaacttgagaaaacttcatcaaactgatgtttaaaagtttaaagt

SEQ ID NO: 5181 - DNA, 1658 bp, Zea mays
  misc_feature (1)..(100): optimal_loci_166843_G1, chr4:211484673..211486330, Cluster 32
atgcaaaggtaacattatgggatgctaagatacaaattaaatgatctcaaaaggattcattgatgcatagaagaagcttatctagcccttgccaatgtcattattgtggtattatagacttttggatttaattaacttttaatactattggtagttcataagctaattggactttgtgctgcgagcgcataaggacaattgtagctttcacctgagagtattctagggtatcgtgttttccacgagtaagcatcgtggcagaaaatcaattcatcatcaaccaagctatatcagaaactcttacattctaactaaatgaaaagataaagaaaccaaaccatgtgattaaacactaggtaacagtagtggcaaaatcaatatgggtagctaagaggacaatgaggcaatatctatgttcttgattatcacttctaaactatggagatcctaatagactaagttagattaaagtgttgctttgctatggataaatctttatataatagtttatgcttacttcggccaccgagttgtaagagccccttctgggcactagagtgttgataacccagatgagaaatgtaggctttatagagaatcagctatagtagctacatgatcatgacacgaacgacatgggtggaatacatagggtatagttccgttgtaaccaagtggacctacataaatctagggtgtgccccaacagcacaccaatggacccaaatttgaatggggttgtgtgtttcgcagggtaaacagccagcctaagcatagaagtttattgatactctgatggacgagtcatagcagcatgtaagacttaaacacgttaattataagcatgcacaaggtcccataagcacgacaaactaaactaggctttaactcacaaatgaaatctaactaaagtctagaagacattcaatcactatgattgtgcattatctcaatgaaagaatgtaacactcgcatgaagtaaataaagaattcatattaaagatgtcaagtcataccacaaaataagatacaagaggacttataccaaactccttgtaatgactttagaatgacaaagaatagagcctcaactctaactcctaactaaacattaatttcagagtggaagcaccattcatggggtccctccaagtgagggagggaatagagttacatagtgagtcgtgttgtgagactgagggagtgcctctatttataggagtgtaggtgacttgggagagtggagatccacccttggtcttagggaatattcccctcctctttgaccatgcatgcaaggctgcatgggagtgaaacatgtgcttgttgcttccatgtggggctgggcagcaaaggatagggttgaccaactttggtgtggctagccgacctacatgtggggacagtcggccaaagtgagcccatgtggccatattgggtccggtcggcctgcatgtggggcacgccagccacagatctgagccttggtcatttgttgacttctacttgctccattttatgtatatttttgtagaaatttgagcttctccctgcaaaacacttaaaacaacacaacttgtggattttattagttcaatgtgtataatgcatagaatttcgctcatacccatatttattcactgagttgtttgcggttg

SEQ ID NO: 5182 - DNA, 3110 bp, Zea mays
  misc_feature (1)..(100): optimal_loci_167152_G1, chr4:213367964..213371073, Cluster 32
gtagcacctgtacctcgaaccatgctttccacatggagattctctggcgtgcgccgcgttctctttgtcccgctgcaggggccgtcgtcgcggcacggcgcgcgtcgcgtggctcacacggtcacgcggttggtggcccgcgcatgggggaaggggaaggcaggcaagtggcagcagggtgctgttcctatcggcgaggagattcgtcgtgcgttttgcggctgtgcagatgaggatcaggcgaatcgcacgaacaatcatgggattgtcgtttcacctcatacgcaagggttcactatacgtaagcgaatcgcacggatgatcatggcctcgtgttcttgctgttctacccacgtgattcgtgacgggattctcgatcggatacaatcacgggtaggcgtgttgcgtagtaccatacatgctttacaatttttctttggctcaagtacctaatcgagagattcgattaagaaatagtagcagagaaaacatgccacactgctctagacacttgtgttttgctacggcttcagggaggcgatgagggtaacaaacaacaatgggcattggttaagaataaggtagaacttacctggtggaaatatcattccaatattgtttagaaagccaatccaagtttttccagggaagaggacctacatgatgccatctctttaatactaataatgtccagtccaagtcacgagtcattgcaacatcaactctgggaggaattaaatatttgattgaacattggagactgattgccttggaccttagcttgctaagcatgttagcaggaatctaccaagtgcagcaacttggtagtcattttgttttcagtaggtaggcagataggtcatgcaagtgactttaacaaagttttttttttgttggttaccatccctttctgcttatttgtagccgttgaaaacttgaatctttttctgctgtctggctaggacatcttttagtttcaggtacagcccagtattctgaaagagaaatcagttgaccatccattgccgcccttgtatcgtgatgtgctgcttcggtaaccaaacctgatttttcttgttgttccatgtgctaggatgaaaacgaactattcgccacagttgccagttgattttacttacatctaaacaggcacaatttgctctttacctagccaaaataccagttgtattctgctgctgctttgccactctaacattttggacttgatgctggaatctttaccattattccattagcatcttcatactgcattacgtcattggtggggccatgctgtaatcttaattttctaccccttagaaaatttgtgccgacaggggaaaaagccgatgtaatcatttgcgttttgataaactaaccactgaagtcgcaacatagaaaatagcatagcctttaacatgtgtcaatctagacttgccttttgtttacttagagtaagaagactagcttcttgaccaagaaccatgtttttattttcaaaagatacaggcaccgtgctcagcctgacaggctgtctgcatgatttcaactagttaatctatagcgtgtatctttttcatataaactgaaaggagactgtccaggtatcggtatggtcattttttctcattttttcagttcttcatcgtgtaatttatgctgtattaggaagtgtatattggtaatcaaaggtgatatactttaaggaaccttcagccttgctggtgataaggagatcacactgagctgatgctcagaatatacgagacagcagtttggtatgctactgttgtcttctgacttctgctatcgctagagctgcttctcacaactgaaggcatttgattggaacaattcctaatgatctttgtacattactctcgctaagttaataagttgtgtcacgttgatgaacattctgacaggtttagctcatatgctcaaattcttctctcacttgtttcaacttcttatttcattctctgtgatgatcatcagatcctccaattatgactagtagtctaggagcaaaatgaatttgttataaacatttgtgaatggccaagcccatcaatatctcctgaaattttatatactcggattttaaatgctttctttccttttccagttgcattgcttgctagctatgattaggatgatactgaggtgttccacctgctggccttaactcatctgatatcattgacagaagacatatgccgtgagcatgataagctactaagtgccgaggccatggttggctaatggaccataaagtcgtctctatcagtttcagggaattcattagagccctccatgatgaaacctggggcatatggtacttaaatgcagtaaggttttaaatagccggttatagtgaccaagatatatcctttttttagtagcaaaaagttatgctatttagcccgacatatcccgctatacccagatatatcccgatattattacttttaagaagcatggggataaatctcttatcccgctatttaaaacactaaaatgcactaaagcatatatatatatatatatatatggcaccatatcagttacttcgtctttctggcataacctgcacgctgttacgcttctatatatttggttttgaaggtagttgtgttctgtaattgtctctatttgtcaatttcattttagaagtaattacttttcttttttattttctattgttgttaaattgtgctctgaaatcttttttatgttaaacatgaggagaatgctaaattgccaaatgaattcataatgcagacttaatctcttgtgatgtgcaagttccaccatgttagcttgtccttctgtaccaaaaacatttttgactaatgctttatttattttgtttagggtgaacaatgtatttgagggaaaaaatggaaccgttaattctgaaggttctctgcaacacatcattagtatttgaaactgaaattttgaatgagttagtggaaaaactgtgtgtcactagttagatgcccatgtattgctacggtttctttaaatgggatagttattcaaacacattttaaacctttacaataagcattcggaaatcttgagcggcttgtggggatagtggt

SEQ ID NO: 5183 - DNA, 1890 bp, Zea mays
  misc_feature (1)..(100): optimal_loci_171120_G1, chr4:234205444..234207333, Cluster 32
attgtaaaatgaaaatgatatgttataccacaccagtgtattgtaaaatggtaaataatttcacaatatattgtatgaacgaaatccacaaattactcacatgtatagtattcaagtgacactatacattttagaaaaaatcttgatatggaaagtaggcatccaagatcctttgcaggagacataattgctcatgttaactaatatgggacgaaatagagaacttcaaatgtaatagaggatgaaagtggaactacaaaacaatggacacagtggcagatctagaaacatatgctacaaggggctcatactccttattttctacatttagtccctcctaagcttcaatgattacaaacttgtaggaagcttaggagagggttctatacttacggcgacagtaggagggggtcgagcctcagccgacttggtgctagttccacccttgaatggaaaggaacttaacagctaaaggggctttagtattgtggccttcgtgtgaacatttcatggcgcacatcatgacaactggcaaaggatttatcttacaaaatattagtgttccattgtctacagacaacaattatggagcaaccttagtgaaaagggtcaaaagaaatactcaagcaccagtttcctaactagttttcatacaagtttttgaaatgtctatatggttctttactacttagtcacactagagtgccggtgacccacatggcctctagtgtcatcgttggctctagtgtagacatgcaaaataatggcataaaggccatgattgttctatggtaagcttagctcaagttcaaaagaaactgatagctatcccttaagattcattaggcttgtttaatgcatggagacttcggagaaaggttgatagtcccttaaccaaaatgggatgacctacatttatgtcacaaagatcggcatcatcatcaagtcacaatgatcttcgtagcataggtcattcttaatcttctaccgcactacaccacaatgtatctcgctacaaacttactttgacatgataattacaactttgtggcaattgcaaaggggattcaactttgggccacattaggtaagcctcaacatggcaggttttacgacctcatccatccttagaccttagtccacttgttatagaagttgacatctttacttactacgagaagcttgaatatcccaactatggtggcaaagacaacttaacgaattcaattgacccaaatataagtatttttccaacgatagacaaaggaaggcaacaaggtcctctttgttgcatacacatattgtcggcaatacccaacagtggtacattaaatagggaattgtgtgtatactctcgaaagtgtggtttggtatagaacacaacgcacttgtcaattgttttgtcacaccatgaaaatgtggatttgtctacaacacatgacacaaattaaaaatatttctacccgtgagagagagctaggtcataccacctatcgaattataccattagagcagtgcgctcgaggtctccctttgtctgtccatgttcgaatcctactacaacttattgcaatgaccaggggtgtcaacactatgtggtttgagttttttaggttggttgttaattaacattatgcccttaaaggcaaattactagcaattcatcgatgttagatctctcaatgaagcacaacgacacaatgtcccggatgcgttagttgggctagtcttttccatggaaacgccacccctctccctatcaacctccctctccttggccaacgacgatggcatgagcaatttgaagccaaagatgttgaccaccggatccatgagcaatccacaaaaaaataagttgaatcagtgtgagtcatacaagggagcgcccat

SEQ ID NO: 5184 - DNA, 1945 bp, Zea mays
  misc_feature (1)..(100): optimal_loci_171577_G1, chr4:236208415..236210359, Cluster 32
  modified_base (600)..(600): a, c, g, or t
  misc_feature (600)..(699): n is a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (1685)..(1685): a, c, g, or t
  misc_feature (1685)..(1784): n is a, c, g, or t
  modified_base (1686)..(1686): a, c, g, or t
  modified_base (1687)..(1687): a, c, g, or t
  modified_base (1688)..(1688): a, c, g, or t
  modified_base (1689)..(1689): a, c, g, or t
  modified_base (1690)..(1690): a, c, g, or t
  modified_base (1691)..(1691): a, c, g, or t
  modified_base (1692)..(1692): a, c, g, or t
  modified_base (1693)..(1693): a, c, g, or t
  modified_base (1694)..(1694): a, c, g, or t
  modified_base (1695)..(1695): a, c, g, or t
  modified_base (1696)..(1696): a, c, g, or t
  modified_base (1697)..(1697): a, c, g, or t
  modified_base (1698)..(1698): a, c, g, or t
  modified_base (1699)..(1699): a, c, g, or t
  modified_base (1700)..(1700): a, c, g, or t
  modified_base (1701)..(1701): a, c, g, or t
  modified_base (1702)..(1702): a, c, g, or t
  modified_base (1703)..(1703): a, c, g, or t
  modified_base (1704)..(1704): a, c, g, or t
  modified_base (1705)..(1705): a, c, g, or t
  modified_base (1706)..(1706): a, c, g, or t
  modified_base (1707)..(1707): a, c, g, or t
  modified_base (1708)..(1708): a, c, g, or t
  modified_base (1709)..(1709): a, c, g, or t
  modified_base (1710)..(1710): a, c, g, or t
  modified_base (1711)..(1711): a, c, g, or t
  modified_base (1712)..(1712): a, c, g, or t
  modified_base (1713)..(1713): a, c, g, or t
  modified_base (1714)..(1714): a, c, g, or t
  modified_base (1715)..(1715): a, c, g, or t
  modified_base (1716)..(1716): a, c, g, or t
  modified_base (1717)..(1717): a, c, g, or t
  modified_base (1718)..(1718): a, c, g, or t
  modified_base (1719)..(1719): a, c, g, or t
  modified_base (1720)..(1720): a, c, g, or t
  modified_base (1721)..(1721): a, c, g, or t
  modified_base (1722)..(1722): a, c, g, or t
  modified_base (1723)..(1723): a, c, g, or t
  modified_base (1724)..(1724): a, c, g, or t
  modified_base (1725)..(1725): a, c, g, or t
  modified_base (1726)..(1726): a, c, g, or t
  modified_base (1727)..(1727): a, c, g, or t
  modified_base (1728)..(1728): a, c, g, or t
  modified_base (1729)..(1729): a, c, g, or t
  modified_base (1730)..(1730): a, c, g, or t
  modified_base (1731)..(1731): a, c, g, or t
  modified_base (1732)..(1732): a, c, g, or t
  modified_base (1733)..(1733): a, c, g, or t
  modified_base (1734)..(1734): a, c, g, or t
  modified_base (1735)..(1735): a, c, g, or t
  modified_base (1736)..(1736): a, c, g, or t
  modified_base (1737)..(1737): a, c, g, or t
  modified_base (1738)..(1738): a, c, g, or t
  modified_base (1739)..(1739): a, c, g, or t
  modified_base (1740)..(1740): a, c, g, or t
  modified_base (1741)..(1741): a, c, g, or t
  modified_base (1742)..(1742): a, c, g, or t
  modified_base (1743)..(1743): a, c, g, or t
  modified_base (1744)..(1744): a, c, g, or t
  modified_base (1745)..(1745): a, c, g, or t
  modified_base (1746)..(1746): a, c, g, or t
  modified_base (1747)..(1747): a, c, g, or t
  modified_base (1748)..(1748): a, c, g, or t
  modified_base (1749)..(1749): a, c, g, or t
  modified_base (1750)..(1750): a, c, g, or t
  modified_base (1751)..(1751): a, c, g, or t
  modified_base (1752)..(1752): a, c, g, or t
  modified_base (1753)..(1753): a, c, g, or t
  modified_base (1754)..(1754): a, c, g, or t
  modified_base (1755)..(1755): a, c, g, or t
  modified_base (1756)..(1756): a, c, g, or t
  modified_base (1757)..(1757): a, c, g, or t
  modified_base (1758)..(1758): a, c, g, or t
  modified_base (1759)..(1759): a, c, g, or t
  modified_base (1760)..(1760): a, c, g, or t
  modified_base (1761)..(1761): a, c, g, or t
  modified_base (1762)..(1762): a, c, g, or t
  modified_base (1763)..(1763): a, c, g, or t
  modified_base (1764)..(1764): a, c, g, or t
  modified_base (1765)..(1765): a, c, g, or t
  modified_base (1766)..(1766): a, c, g, or t
  modified_base (1767)..(1767): a, c, g, or t
  modified_base (1768)..(1768): a, c, g, or t
  modified_base (1769)..(1769): a, c, g, or t
  modified_base (1770)..(1770): a, c, g, or t
  modified_base (1771)..(1771): a, c, g, or t
  modified_base (1772)..(1772): a, c, g, or t
  modified_base (1773)..(1773): a, c, g, or t
  modified_base (1774)..(1774): a, c, g, or t
  modified_base (1775)..(1775): a, c, g, or t
  modified_base (1776)..(1776): a, c, g, or t
  modified_base (1777)..(1777): a, c, g, or t
  modified_base (1778)..(1778): a, c, g, or t
  modified_base (1779)..(1779): a, c, g, or t
  modified_base (1780)..(1780): a, c, g, or t
  modified_base (1781)..(1781): a, c, g, or t
  modified_base (1782)..(1782): a, c, g, or t
  modified_base (1783)..(1783): a, c, g, or t
  modified_base (1784)..(1784): a, c, g, or t
cctacttcgatgaatcagcttgattcgttcatgccttgtcagcacctctcgggccaccagtcgggagaaaaaaatttagcagcgctgggctttggcttctggcatggtgatagcttgtagttgtaccatgtgttgacgctatagcaccgtcggttgactagtctgttctgtgggctgtctgtcaccagactgagaaagcaaggacaacactctgcaaacataagacacgcagacgcagacgcagacgcattcagcacagcggattcaattcaggcagctagcaagcggcgacgacaaaacggcaacgtcatgagagccacagcccacatgagagagagagagagagagagagagagaccatggccatcagtccatcaattatatatgctcttcttgcacccacatcatatgacaccaccaccatgcacacacacgcgcgcacgcgtgtactacatctcccttaagcttcttcgttcagtttgctgtgctctcctccaatccttgcccccagctaccaccagggccataggctattgcttttgcatactgggaagcctggaacactggccgatcggcccctgctattgccatattccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaccgattctagagattcgtcctgccagcctgatctgatctgaccaccgaaacctagctagctaccaagccttgggttgctgtagtgcaggtgcggcatgcagttgtcaacaacagcctgatctgatccacgaggaattgaattctcacacgtggatggccttggagagatggactagctattctcttcggccattcggccatgcacgcacgcatggagcttgctggatgcaatgcatatgcatgactctccgtcatcagatcatgtggcagcttcactctctcaccaccaccaaatgatcaagcgcgcgagcggatggagttcccgtcggccgtcgtctagcttagctagttccctgcgatccctcccaaacaatctcttactattaccgtcgtcgacccaataacgtacaatttcctagctctcttgcagatcttgtcgcagtcgatctcatgcatggcgtggtattttcatctcttcatcaactgtttcatgcatggcgtgtgccttcttcttttattggaacagctattagcgcgcgcttattatagatctttttattggaattaatggaccaaataatgtttttgcccttgcacagaagttttttggagtgtttcttgcccaaaagtcgtcgtcaaagcaattgttggtactacttcattctttcgtccaaattaactcctaatgaacattgtgctagtttctttggggccggggcatctcgactcctgttcaagctgaccagatcatccccaatataatatggtcatgcatgaaaggtaggccgacctgctaatcgcttcttgcttttccattgattctgtttgctcagaagatcttgttgtgtaattgaatttctccttccattggatgctttatttctgtaacgtaacaccgctgtattatatatgctagagcttgctttgcagacgtttttttgttctggccaagagcaacagcttttcttcgaaaaggcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttacattttggggtccctgcatatacaaaacagtcatcctaatattagtcccccacaatcaaacagaacggctttaaagcgaccattcgtgtgggtatgggctcacaaatcgtcaatgggggacactttttcggggaggattgtctgtaacgatcc

SEQ ID NO: 5185 - DNA, 1452 bp, Zea mays
  misc_feature (1)..(100): optimal_loci_172954_G1, chr5:3322061..3323512, Cluster 32
aactcgagacgacgccccactttatatctttttaactattgattgacctatttgtcgttactcatgcaggtatcttgttaggggttaaattgtcaaacaaaaacaaggggaatcagacttaattcatccgactaaacaacaattgttcgttcgatgagaaaccagcgatccatatcagatagccatacaacttttcttttttcaaaaaaaattatactcgtattttttatgcacgaaattataaataaaattttgagtggatatgttgcaaaaaaaaagtttgttagtaaacatatgtagcattatttatatataacaagatgaatgatgaattttttacattgtttttcacaattgaattaagggttttggtacatatagatatgacaaacttagctcgtgggtagttccaaacaagaacagacgtaatgataggttgaacataaaaggggtttagagcaatatttattttaggctcaatgataggttaaacatgccacaagaaatcactctaatatccaccaaacccaagctaaatgagttcaattcaatctgaccaaggctgaaatagttaaggttagtatagcttttagccaccaaaaccaagccaagggagttcacttcaatccgaccaaggcaacaatagttaaggttagtttatcttgtatcaccccactcctcaacaaggaggaactttagctcatcaggttggagcttgtaaccttatgtatcatccatatagagcagtctatgattaggaatagaacgtagggtactacgcacaccgtaaccaaatccctataaaaattctcatgtgataggttcttgatgtcatgaccttaatattgtacggtgttatgactcattccttacttccctatcaatccttcctcgagtacgtcttggtaccttgtgtatgtgctacgacaatgaaacaaccctcaagttcgaaagtgatggtacaaaagacgcagcggaatcatcttcacgacgtaagagaaaggggaaataatcatactacacctagtaggcaaagtgtaaaagaccatatgtttagaaataaatttttgatgaaaataaatcttaaaattatttaaaaggattaaaaaaatttaaaaaaacgagcagagcatgctgcagtttgacttcttttttttcttcctcatagaaaagctttgactttcttagcaccatccttaacctctagaacacatcatgttgtgcaagtgaagtactatgtatctgtgactattatcattcatcagtggcatcgaagcggttggtcatggctggtggtgttgcctgaagaatctattcaaagaaacgaaacagatcgaagaagaagaaaaaaaggcacttgcacaattggttcgttctcgctgccgtcacaagattctagtaaggtgtggcttggttgaccttgagggccacacactatctagtacgttctag

SEQ ID NO: 5186 - DNA, 2269 bp, Zea mays
  misc_feature (1)..(100): optimal_loci_176011_G1, chr5:20915478..20917746, Cluster 32
ctcagtctacccaggaacatcggaagcagcaatcgcaacgccatgacaagctcaataccctacgggagaatcaccgggcgggacttcgaagcccaacagctggtaactgctctgataagttctcaggtcgagaacccagtttctgttgtctctattgtttgttggtgtaggtggcataggtaagactgctctagcacagcatgtgtacagcaacgctagaataacagagagctttgatgtgaggatgtggatttgtgttacttctctcttggacgagttgagaatcacaaaagaaatgctggagtcagcttccagcagtcggtttaggcatggtggcatagcaaatttcaatagacttcaagtcgccttgaaggcaaggcttgcttcaaaacgtttcctccttgccttagatgacgtttggaacagtgacaacaaaacaatagcaatagaacaagagaactggcagaagctgctagcccctctgaaggacggagcaaaggggagcaagatacttttgacaactcggtcaagtatagtagcagagatgctacaatcatcctctataattaatctggagaccttgcaagttaatgattgttggtccctgataaagacttatgtgtttgatgagacaaaacataccatcgactcaaaactggagaacattggaaggaaaattgctgagacactcagtggccttcctcttgccgcaaaggtggtagctggacacctgaaacgtaacaacagtgtagatgagtggaaacaagtcttgcagagaaatgcagtatgggaggaaatcatgccaattctacgaacgagctatgacaatctaccaccacagctgaaacaatgctttgcatattgcagcatcttcccccagaaactgggaatttgaagctgagcagctgattctgctgtggttagcacaaggttttgtgcacccagatggttgcaggagattggaggacattgggaaagaatacataaatgatctatgtaataagtcattcttcacgatacagaagaaagaatttgtcagctattatgtgatgccacctgtaatttatgagctcgcaaaatcagtggcagctgaagaatgcttcagaataggaggtgatgaaaggacaagaatcccatcgtcagtgcgtcatctatcagtacatctagatagactttcagcacttgatgacacaatcccatacaagaatctacgcactctcattttccttactagcagaacagtggctccaattaatgtctccatccctccagtggctctcaataacataagaagcctccgtgtgttggatttatcctgtgcatgatgggacgatttcctgatagcatatcaaattgtgtgcatcttcgctacctaaatatctcatctactaccattgcaacagtaccagaattcttgtgcaaactctaccacctacaggttttgaatttatcaggttgtaggcttggaaaattgccttccagaatgaacaacttggtcaatctacggaatctcacagcagctaatcagattatttcagctataacagacattggcaggctgaaatgccttcagaggttgccaactttcaaggttaccagagagaaaacacaaagtatagttcagcttgggtacctactagaactccaaggatccctacagatcagaaaccttgagaatgtcgaagctccaattgaggcaaaggaagcaatgctttgcaagaaacgccagctctctgtgctgcagctaatgtgggcatctgatcgagatgaggtaaatggaaataaggaagaggatgtgctagaagctctccaaccgcacgaaaatctgaagagactagacatcgtgggttggatgggagtcaaatcccctaattggcttaaaaatgaatggttaagcaatcttgagcttattttcctaagtggctgaaatgcatgggagcagcttccaccacttggtcagcttccctccatccgaacaatctggttgcagcatttgaaaatgttgagacagataggcccagaggcatatggcagtggcagccaaatgaagccattccaatcactagaagagctggtgcttgatgacatgccagaactcaatgagtggttatggagtgaccagacaatgaggaatctacagaatgtcgtgatcaaggactgcaataagctaaaagcgctgcctccagtgcctcctaaccttacagagataacaaattaacaattgcaaggaaagggtattgggtgccataccaccatgatgtaaagttgg

SEQ ID NO: 5187 - DNA, 1726 bp, Zea mays
  misc_feature (1)..(100): optimal_loci_181114_G1, chr5:48831931..48833656, Cluster 32
ccatggagactggagaggtttaatattaaagaaacacaaattcctccttccaataatcaggaaattaacaattgtccttctccttgtaatatttttgttggccataatagcgattaagtctgaaacgctagagaagattgactacgaaaacatcattaaagatttcaaataaagattatgtaaccgcgttatgatgctgaatcataatgtttgtataaatatatacatggttttgctagttttgtacaaggccccctgcatgcctaggatccaaacatgatattaatttcgtaagagctgtaaaattgaaattttcataaaaagagctgaaatgcaaaaaaaaaaaacggtgaaaaagtcccgtccggccggtttttcttaggcatgcacggtgccatatgatgcggtaggactttgtacgttgtgtgcgcgatcatgtatttgcagctcaacgtgttacgtagccggaaaattaacctggaagcatgcatgtgacatcgttgatgtcattacattcttgcttaggtacatatatttttgaattgggccagaccgaaatctgagacgggaaaacgtgtacacgtcctctctccccggccagcagcatatatgcgtgtggtccatgcctgcctcccaaaaagaccaaacaaggcgaatatacctgtcggccggctatcagagtggtaaggaacattttagtctttagatatatatacttttagtcttggtaaccaaatagagtaggtagagactaaactttagcctaaacaagcccttaagaaattcgctcttaatttatatatgaaagtattattactacctcctacctacaccttttggtgtttcattgatgggcatgcatgatgggctcagcgtccaccgttccttcaattctcttacagctgctgcactagtctgcaccatggattaggaattgtgacgatgttgacgatgcagcagctgcagtagcatgcaccatgtgtcaccatgcatgcatgaatacgtactggcactctgcaggcaaccataccggcctctactcgtccagccaggggcagcagacgacgtggtgctgcacgtactgctgctgcgtgtacttgcagcgagctctcaactactgcgacaacaacgttactcatctttttggagaggtttcaagtctagaggcctctataggggtgataacacatttgatttttatccaaaagagaacatagaatattcgatccattagtgccgccacagtgctcgtactgaagccgagaacatgcgctgataaatgagacttgagggatgtacagtcgcaagcactgcagcgacgtattacatttgaaaacgacgttggaccagcatgcgccgcactaagctattaggtagggaaggcactgtacatatacatacgagcgaattattggagacacgtgtgtacataatctcacgatgaacgaaggccagcgcaatctatctggcgggcggccggtgaaaactgcatcagcatgcaatgtccaaacggtatatatatatatatatagtaccaaccctaacccatttggaaccgtgtccgggccatgtttgggccaccattgccgacacgcctgtgtttggcccagcccagccctcgccaacagtcgtcacgaccacggcacgggaagcaacatgctcagcacggcagtcggcatcgccttttgctccatgccccgacgcccaacctcacagtccccactcc

SEQ ID NO: 5188 - DNA, 1752 bp, Zea mays
  misc_feature (1)..(100): optimal_loci_181825_G1, chr5:53519652..53521403, Cluster 32
tggccggcactaggcttggccacgtagtgctccgaggatgctaggttagtactcaggtgagcctactttacgtttgtcttgtgctgataaagtcttgaaggatattttgctagtgagcatatggcttctccaaagcactgacaataataagaaacgaaaataattgctgtcgaggaaaagaaagattaaatttatctttgtatttcgaatgatgatagtacaggtagctttcttggcccgtccatcattttccgtccttttggagtgcccttacattcatctattcatcattcattatccatctgtcaaatttttgagacggctccgtcacaaaagattcgaaagcaagagtaggaaaaggatgcctgccattcggagctctccctgcactaattaaaaactctgtcccaaaatcaaagacgtatcaatatatttatatatttatatataagttttttatcttttctaaatatattatatttaaatatatatcaaaaggactatatgctcagaaaagtcaaacatttttaagttaaatgagggagtgctttattggaaaaacatcctaggttgaaaattgaatagctttggtagatgatagttcaaggttgcaatatgaatcccctccgttctaaactatatgctgttttatcttttctaactatatactttttattatatatttatatatacatcatgtctagatatataataaaacctatgatttagaaaagctaaaaaagacttgccatttaaatcaggagagtattttttgaagtttagaagttgaaaaacaattcaatgacgatttataaaatggatttcccaccctttttaaattttttattgtggccctttttaaatttaaaaacagggagacataatttcgtgagtattggccgattaataaggtgtgtcatccacctaactgtccaatgtagatgagatatatatcttcttttggtcttggaattaaagataagtaggtaaagttaacacgagatgagttgctccttctttgtcaaatgaaacagatgcatggcttgtttgagtcataatcttgcctccagaatctattagactctggtgacaaatacctgtcagaataaaagaggcagggtttttatggtacgaacatgccttcttaggacctcgcaaaaaaaaaaggtgttcgcttcacactgttttttttattatgtcgacttcaagtgtgcttatatttggtgattgctggtctggtgatgtgagaagttgagtctttttcttttgccattttttgaccaaggagctggtactgccgcaagtaccaactaccaactgcaaaaagggatgcttaaatattggcggggtctattatctgattagaacttttcagctgttggaatgacagtctaacatatacataagcttcctgaacaaaacatataaatcgtgttatgcagacataaaaaatagggttaagttttcctttaaagaaagaacaaaggagggttaggttgaaataaacatgaaacaacagacctggtgaatatgagttgctatggcattgatttgataaaaaatatccaacatggaaataattggaataatctaattttttcacaacaattaaatcctaccaaatagcccactttatcccttgtgcctagtagtactttctatccttcacacaaaattttacacaccaacttgcaatcatattctagcatgacaattctaataacgtaaaacaagaagacaattgcacaaagg

SEQ ID NO: 5189 - DNA, 1794 bp, Zea mays
  misc_feature (1)..(100): optimal_loci_199880_G1, chr5:172917373..172919166, Cluster 32
agtaatgtaaaatcaggctaagctcaagctcagagagtaatgtaaaactatgaagaactgcacaaaaggaggatatattagtgatcactgaagaccatatattttttttctaaaaaattggtacaattcatcccacacatacactatcagcaactgaacattattatgctataactctagcgtaagaatgtctgaccaagggaatgtggggaaatcaaatcgtgtaatgggctcaattgagccctatgccgaaaatatatagcccatgctgctgtcagcatatcgaaaggttgcagtcctagaatgccaaatcagacttgagttttgatacgggttcccaccatgcaagctagagctagcctagtggcgaaaggatggtggttgaaagcaagtatcatgatgggcttgattgatggaaacggaggcttgctttgagcacggttacaatcatgtcaaacatgcattctgaatggatcagttgtcatgtgcacgtcgtaacagtgtagtgtttaattaatatgacccttttttgttttctaagtgctaaagattctacgcttgtggtgcaaaaaaaaacccgaatggttgataataatggaggatcagttgcatggtgaaggaggatcaactaaagctcttttctctccacgcccccaaaaaaaggttctagcttcggaccactcttcacgattcagaaataattaatggagaaaccatgtaccatgttacattacaacttttacatgttctctcagttttcatgtacacatggaattagctagcaacacactacttagggtggactttgaagcacaagataagctctatttatctgcaacataccaaatataagtaaccagttaactctgaatgcttccaagctctgactgatatttttatttttttcatcctacatcgataagtttgagtgtctgacaggattggggtgacgtgacagtgcatccacacacgatttagataatgtcatgtcaccattgtaggcagatcgtctgtactttttgacaattacaggcattcagtccatttctgggtttccaagatgtctattcttaacatgtttaaagaaagtagccatatgcctttcagaaactttctagagacatgaggcatgagtttggtaaattttctccaacacaaaagccaattctaataaaccaataagcctttgttaattgtccctttctttgatatactggctataaacacacagtgggttttaaaaaatcacctgttgttagagaagttcaatcataaagtttgtccgtcgcaatgatttacctctcaaaacgttgactgctaaactccaacagcctggatggaattcatgcatgggaggggttaggagggtacctaataagttttgatacctgttgcacaggcacaacaaacagcacactgtatgccttcgaactgctataggcaaggatctgtttgtggtcccatgaatgaatgagcgtttggggtcttaatttgcctctttaaccacccataaaaacaaacacatctgagctatgtcttaaaagctatctcagtgcgcaacctcctagcttatatataagctgtattcctctttagcaaaagtcaatatggggctgtgttgctaactgaagctagctagtaggtgagctaatgtaaaatgtataacttcaaaagttgctaactttggaagtgacttcagggggggcctacttgggagttaggcatgtgtcttcttcaaagtgatgtgggggtaaatgatgttaatatggagcatctccactattgattatagca

SEQ ID NO: 5190 - DNA, 1917 bp, Zea mays
  misc_feature (1)..(100): optimal_loci_201017_G1, chr5:179270896..179272812, Cluster 32
  modified_base (1750)..(1750): a, c, g, or t
  misc_feature (1750)..(1849): n is a, c, g, or t
  modified_base (1751)..(1751): a, c, g, or t
  modified_base (1752)..(1752): a, c, g, or t
  modified_base (1753)..(1753): a, c, g, or t
  modified_base (1754)..(1754): a, c, g, or t
  modified_base (1755)..(1755): a, c, g, or t
  modified_base (1756)..(1756): a, c, g, or t
  modified_base (1757)..(1757): a, c, g, or t
  modified_base (1758)..(1758): a, c, g, or t
  modified_base (1759)..(1759): a, c, g, or t
  modified_base (1760)..(1760): a, c, g, or t
  modified_base (1761)..(1761): a, c, g, or t
  modified_base (1762)..(1762): a, c, g, or t
  modified_base (1763)..(1763): a, c, g, or t
  modified_base (1764)..(1764): a, c, g, or t
  modified_base (1765)..(1765): a, c, g, or t
  modified_base (1766)..(1766): a, c, g, or t
  modified_base (1767)..(1767): a, c, g, or t
  modified_base (1768)..(1768): a, c, g, or t
  modified_base (1769)..(1769): a, c, g, or t
  modified_base (1770)..(1770): a, c, g, or t
  modified_base (1771)..(1771): a, c, g, or t
  modified_base (1772)..(1772): a, c, g, or t
  modified_base (1773)..(1773): a, c, g, or t
  modified_base (1774)..(1774): a, c, g, or t
  modified_base (1775)..(1775): a, c, g, or t
  modified_base (1776)..(1776): a, c, g, or t
  modified_base (1777)..(1777): a, c, g, or t
  modified_base (1778)..(1778): a, c, g, or t
  modified_base (1779)..(1779): a, c, g, or t
  modified_base (1780)..(1780): a, c, g, or t
  modified_base (1781)..(1781): a, c, g, or t
  modified_base (1782)..(1782): a, c, g, or t
  modified_base (1783)..(1783): a, c, g, or t
  modified_base (1784)..(1784): a, c, g, or t
  modified_base (1785)..(1785): a, c, g, or t
  modified_base (1786)..(1786): a, c, g, or t
  modified_base (1787)..(1787): a, c, g, or t
  modified_base (1788)..(1788): a, c, g, or t
  modified_base (1789)..(1789): a, c, g, or t
  modified_base (1790)..(1790): a, c, g, or t
  modified_base (1791)..(1791): a, c, g, or t
  modified_base (1792)..(1792): a, c, g, or t
  modified_base (1793)..(1793): a, c, g, or t
  modified_base (1794)..(1794): a, c, g, or t
  modified_base (1795)..(1795): a, c, g, or t
  modified_base (1796)..(1796): a, c, g, or t
  modified_base (1797)..(1797): a, c, g, or t
  modified_base (1798)..(1798): a, c, g, or t
  modified_base (1799)..(1799): a, c, g, or t
  modified_base (1800)..(1800): a, c, g, or t
  modified_base (1801)..(1801): a, c, g, or t
  modified_base (1802)..(1802): a, c, g, or t
  modified_base (1803)..(1803): a, c, g, or t
  modified_base (1804)..(1804): a, c, g, or t
  modified_base (1805)..(1805): a, c, g, or t
  modified_base (1806)..(1806): a, c, g, or t
  modified_base (1807)..(1807): a, c, g, or t
  modified_base (1808)..(1808): a, c, g, or t
  modified_base (1809)..(1809): a, c, g, or t
  modified_base (1810)..(1810): a, c, g, or t
  modified_base (1811)..(1811): a, c, g, or t
  modified_base (1812)..(1812): a, c, g, or t
  modified_base (1813)..(1813): a, c, g, or t
  modified_base (1814)..(1814): a, c, g, or t
  modified_base (1815)..(1815): a, c, g, or t
  modified_base (1816)..(1816): a, c, g, or t
  modified_base (1817)..(1817): a, c, g, or t
  modified_base (1818)..(1818): a, c, g, or t
  modified_base (1819)..(1819): a, c, g, or t
  modified_base (1820)..(1820): a, c, g, or t
  modified_base (1821)..(1821): a, c, g, or t
  modified_base (1822)..(1822): a, c, g, or t
  modified_base (1823)..(1823): a, c, g, or t
  modified_base (1824)..(1824): a, c, g, or t
  modified_base (1825)..(1825): a, c, g, or t
  modified_base (1826)..(1826): a, c, g, or t
  modified_base (1827)..(1827): a, c, g, or t
  modified_base (1828)..(1828): a, c, g, or t
  modified_base (1829)..(1829): a, c, g, or t
  modified_base (1830)..(1830): a, c, g, or t
  modified_base (1831)..(1831): a, c, g, or t
  modified_base (1832)..(1832): a, c, g, or t
  modified_base (1833)..(1833): a, c, g, or t
  modified_base (1834)..(1834): a, c, g, or t
  modified_base (1835)..(1835): a, c, g, or t
  modified_base (1836)..(1836): a, c, g, or t
  modified_base (1837)..(1837): a, c, g, or t
  modified_base (1838)..(1838): a, c, g, or t
  modified_base (1839)..(1839): a, c, g, or t
  modified_base (1840)..(1840): a, c, g, or t
  modified_base (1841)..(1841): a, c, g, or t
  modified_base (1842)..(1842): a, c, g, or t
  modified_base (1843)..(1843): a, c, g, or t
  modified_base (1844)..(1844): a, c, g, or t
  modified_base (1845)..(1845): a, c, g, or t
  modified_base (1846)..(1846): a, c, g, or t
  modified_base (1847)..(1847): a, c, g, or t
  modified_base (1848)..(1848): a, c, g, or t
  modified_base (1849)..(1849): a, c, g, or t
caactgcatagatctggacaattttttaacatcaagggaacttctcaacagtaaacaggagtgcatcattcagcatatttttttgcaggtactaaagtttagtgtactcagaaatgttcttactgaagatgtcagcagccaggttggctttcttaattgcttttgcagcaccaagtctgtgccctccctagtaaaagaaaaggaagagtacctcagaagtcggaacaggcatactttaattaagaatatttgtaggcacctaggttacaaaaagacacggtgggatacttacaaccaagcaggaggagggcagtgaagatgagtcacattgagattgttaacattcaggactccagacctaacatgagatgtgcgtagaagaaaatcactgaaatctaatgcgcttaaaccagtggaagagttatcttgggctaaatttggcgatttgaaaggaccatagatggaaatttctaaaatgaacaatgatccttaaaggtgaattcggagatacataccagccatcatcaagatggaaggccaattgatatgaacaactagggttgaagtctatcgacagaatcggacttgaaacaatgtttgattgttcctgaaaaatatcaatgccagaacaatggtttgcaaaaagatatgtttcagaatcagacagggttcccgattttagtttatgagtaatgcaaaaaaaatatactggtttatatcatgtaatctgctaaaaacaaatatatttcaatgttttcgttgaaaatgttggaatataacaaaacgtggttggtgtttcagaatgttacgctaaccagggacactctaaagagaagaaaatggcaggggggctccagatcctgtttctatgattgtgaggaagaagaatcaattcaatactttttggatgtggggcttaactgtgcaactgaatctttctgggtagtatgatatttggattgatagctggtttctatggggaaacagttccatatagatatagttagcccagctggtgtttgctggccgatagggaaaaaagcaacaccatgcatatactatgaaaacaaaaccatcaaatctcccaccgagattatctgctagagggcaggattaaaccccaggataaacattttcgagaaggggcagccatgttgcatgcagcagtgctgtttccatccttgacaagcaaggcctcagcagcataatgcaagcaaggtgctgaacctacaaggtgagacctgacagttgaagaagataatattaaatgggagatcttgttggtgaaggtcagctagtacagaggaaattgcatccaaaatccaacagaaaatggtaggattgtaaacttgtgttagtagattttccttctctgtggcagtttttctgcgtgggagtatggtaatccaaggtgttgctttgatgtatgacttgaaatattaggtgatacacatacttatcacaaacttcaaatgatttgtactcattaccatggtaaagaaattcagaagccgtccactatagattatggttttggatgttaaaaatccaaaaaaaaaaaagttttcaacatcagtccaagtgtaagaagatgctttctgcagagatgagtagacactaacaaaaacggattaaggaggttcaaaaacctaggttgaatggacataaaattgtattctcagcagacaaaaatatcatgcattcgaaaattcagaaggactgcaacaagtatgtgtcaagcaatggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcgccggtatagagccgtcgtgattatttcggtttcgagaaaacccccccctctaggcgactttc

SEQ ID NO: 5191 - DNA, 1413 bp, Zea mays
  misc_feature (1)..(100): optimal_loci_202250_G1, chr5:186876677..186878089, Cluster 32
aaataacacaccgtgctaagttcgaggaccgctactgcatcttactcctacgaaacactatagttcttacctctcagcccatctacatgttccatacaaacacgtttctgtctgtaccggctagtgcttgagaactgctaatgtcgttatcgtcaattgatcctttggtccaaatgcaggcagctgtgtctgactgaggaggcctgacgcccaacccaaatggtctccagatatgtaaagcggcaaacacggtctctaactctgtacctattgacttggttgcaagggagtggcacactggtccattctaagctgcattgcaggcggcgatgactggcggctcgtgcgttcacctaccgggaagcactatcacgcacgagcagctctcgaaagccccttttgacgcgtctacgtattacaagcaaaccacttgacaggcgtgctctgagtgctccatctccatgttttgttgatcttttactagcctttctttttatcttcgaaacatgaacgtggaacatgttcaaaacaaagtttgagtgccgcttcagttgagcttttcaaattaaaaggtgggcaggtgcgatggatgaagaaattatatagtagaagcaacgcaattaagaacaacaagtggaggataaggttgttttgttggattttttacccttccactccgggcagcgttttcatacccctacaatcattggcctgcccaccagctccaaattagtgtaacttctgatgagtgtgaagcgactcaaaaagaaaggcaaagaataaagataaagactgtatagtggtatggttacaaaatagtgtaggaatgcactacttttctcctgaaaatgataaaaatatagttccatcgctagttaataaactacttaaagttaagttagtaaactacttaaagtttgacttgatttacaaagagaagtacaacactgatttagtatcaataataatgctagtgttttctttctataaatttgagcaaagttaagttggatgtttccaactacgcgtctacgccacgctggaattgcattttcttttgcctctttcggaaagagttgttagttgtatcttttccagacaaattgaaagtattattgttgcactacgaattacaaaggccgagatatcagagcggctgaatggcactcccaatatattaaccgaaaaattaaagttggttgttgcgtaagatttcagaagctttcatgcaacacgatgcatatggtgcgagacccattacattcatcgacgtaaaagaatattctgtaacgacacgaggcattgtacgtcggtaacgataaccacgtgggggatggtccgattatactactctttgcaggttgcttatttttacctaggtaatttgatttgcgatcatcaaccttgtgtagt

SEQ ID NO: 5192 - DNA, 1462 bp, Zea mays
  misc_feature (1)..(100): optimal_loci_204442_G1, chr5:199122195..199123656, Cluster 32
ctctcttctagtcacatgcgtatttgccctagcgttaagacatcgcatggtagtgccgcactatagtttggccttcttttgctacaccaaactacctagaaccattctagctgagccatttctattatttgccctttagtatgaaaccctacgacgagctctatctttgcgatgtggttcaagttcttgtagagctatgttcctttgtgcatgatatctggtatataagtgctagtggtggttacattggttagaagaagggattccccaattgatattgaatatgtctgacacgatagtaccatgcatgatgttgtcatgttactcagtctgagtccctcaatcgatcgagtttgagttccttgatcccaccactcagtgacttcattgttggagtgtcttaggtacccctggtttatatccttaacacattgctctcaccaaatatccgctatagagcaaagcgattgaaatagacaaaaaagaacacttacactaacaacatggtagccgatgacttcagccaacgtcgaatcccccacctagaggatgtctcttcgtattgtgcaatgcaaaagaatcgacacaaacttctaagaacttcatgccccttgatgggaaggtgtccaatgttctagtaatcaaagccacatgccatctttgcactataggagactcctagaaaaccagcaatctagtaagactcttccttggtctgatccatctcccctaaagagctagaacttgagtacagttgtggataaccatagtcgtgatgttttgctcccaacttcaaacccccatggcccaaattaaaattggacatctaccatgtcatgggcgacacaaatagacccctgccaaaatctagacttgcccttctcttgttccctttaacccattaactcagcatacctcttcttcgatgactttttcgatgccaaatttttatgacattgccactagcatctcacatcaagggctcaactgattaggcccccttcttgacctaatgttctttcacgaaattttccaccaggatcaccgtttattcatcatggaaagtatcaatggtgatgagtagtattattgagtatagattgtgagaagtatgttggtgactagtagatttactctggcaatcaggactagtaagagaactttgaataaggaaagtacaacatgagaccatcgttaactcctaaccacatttaatatcatttaattcatgtgcatatgtctacctttttaaccataaagatctcctatcttttgtactttgtaccttgaccacctaaaggttaaattgcatctaagtagtacttctcgtgctataaactaaataaccatgacctattgctcgaccaatgtcatatataataaagataaaatgcaccttttagcaacatggataaagggtgttagagtatctaactacttctcaaatgctttagttttcctc

SEQ ID NO: 5193 - DNA, 1827 bp, Zea mays
  misc_feature (1)..(100): optimal_loci_205142_G1, chr5:203106065..203107891, Cluster 32
tgagagagattggacaaaccgaacaagcccgggagtcgtagacactagacctgcttgctcatgcgttgcaaagttgctgattatttgatgagggaaaataatcaagttcgagccgtgactgccgcgacagcagcttcaccgccgccagcccgccactagcagtaggtcgcctgcgggctgcggggcctaaccgaatgcacgttttcttctgggccggtattctatctaggctgggtgcatctccgtggatcggcccacaaatccaggctgtggtgagcaccgtggcatcctcagcagccgctagaccactgcttcatatttcagcatcctcgagtaattgatttattatttactccaattagggatgctggatccggtagtatatacgagttcatttggtctcagtttggcagttaagtgtatgatgcgggagaactcaagattttatctaggttgccttggtgtgtgattatgcaccctcaaattcaacacctatcaatttggctaagatggtctcactgggaaattttatctaggttgccacggccgagcgtgcgaggggaccaggccagggcaagcacgagcggctgaccaggggaggatgcacaactgaccaagggtggcgcaggctaggccggcagggccacaacgacgtacacggggtttgacaaggggcagtggacgatgttccttcgccgctgctcgatcgctaggagagagagagaagaatcatgagaaagaataacagaccattttttctccttaatcagtgataccgtagatattttttcttctcaacaccaccaaacttagatttagtggagcatctattgaggtgttttactaatttagtgaatctataagtagatctatagatttggtggagcagatccaccggtgaagctgatggagacgaagatgcttggctaaaaagtttagatggtgaagctatcatgaacaggaacaggaacctattgatggaagagttggagtaagtgtttacgtagccggcaaacatatgtattattagccttgacctttctaaaagttggttttcatcattgaatgctagtttcatgattacggttccctttccaaagcacctcctgcttgctcatactttactgccccaccatcagcagtgctatttgttcatactgctccctcatcagcggttgagcagcaaccgcaggtaagtgcatggtgtggattcaaatgactgaggccacaatagtttggaagatatataagaggaaataacagggatttcttgcaagtttgaggcctcctcaccaccactcttgttgacttctccgaacaataattatatcatctcaaaattgaagttgttttgacaatacacgtgtaattgttaatgaatattaggactcaagtagtctgttgttaagtttcgtggttatatcaaattgaaaggtaccatgcaagaccttaacatctttttcgtacgttttcataacagagacatacattgctatggtacattgatactattcagaaacatagaatcttacgtggttccttgtttaagaagctgcaaccggatactttttcgcttcattgtttgaacacacatatttccgatacccatcgtagctacattcaaattggtttgcttacccaacaccaaagttcagtgtcaggcttcagttccattaggctggttctagtccgtaaaatattagaggcacgcggaaaggtaaacatctatgtatcactcggtcgttaccggtaattactaaagattactatctacttgcttatctacttctttgtcgcagattgtatccctgtatatccggagtcttc

SEQ ID NO: 5194 - DNA, 1587 bp, Zea mays
  misc_feature (1)..(100): optimal_loci_207448_G1, chr5:214908748..214910334, Cluster 32
tcaattccaaatcttgtgcaaactttaaaaatcaaatctcgcccttcatatttggagaagatataaaagttctatttttgtaccaaaaaatccattcctatcaattatggaggatataaaagatattttgaagttggtcttacgatacatatttcattaagtgatggaagtttatttcaaaccaaaagaccaacatagaggggagagggaggacccacattggtatttccacatggcaagatcgttcaagactccatgttatatcatattggtatttatattatatttatggtgatttggatggcatgcattatttatctcagtacttgtaatttacaaggcttagaattaggtctacaggtatgtacaatgtatattaatgcaccatgtgttaagatgtgtctagggagaaagtgtaaaaaacaaagacaccatattattatcaagacacacgcctctgactcggttttttaagcttaagacatagcttcattagtacaatacacataaataagtcgtatcttatagaatttttattgaataagacataaggtttagatacatgcactcatacctagatatgtatatattaactatgtcttctacttaagaaaccataccacggtgttctttgaatatatagctaccataaattataccatcgtcccggcaaactgataaccattcattttgcatacatcaagcctctagttgatagaagtctccactcaccacatattaaattgtttagattaaccagtagctgaaataaaatatacattggaaatgttttggctgatcacaaggttcaaataaataaattaaaggctagctaataagcatatatatatatattattaactagttcgtcatttgatgtttacatatcagcatctaaaactgtactcaaatacaagggattctagccttctaggggacagaaagcagtttttcattaaatacttttccttttatcagccaatcaccattaaccatattgatgataaaatttgattaggatgcgttacctatagctataagagggtacatctaataaaggggtttatcaggtccgtcgacccgatgaactttgtaaagtaaattactattcaaactctcaaaactctatatcatgtgatgaaattgatcctgataagttcaaatgatgttcttagctagattcaccactgcctatacatagctaattgattgttgtaattagaagcaccaaattgcttataattcaatcttgaactgaaagaaaagagagcaaaacaggctgcagagaggaacccgccagccccaaaaacagacagaggcacgtacacagaaaacagggctctaacaatctgcatatcgtcgccatatatctcttcaattcctcatattggctgcatatcgtcggattgttagcggcagatccaccggcagctgtgcatgcttggctgcagagcaaaattgcagaagctactgacgtagattttcgggtggacgatttactacgttgacgaatttctagctagtagcaccaagaaaaaaaatccttaactagataaggtaaacttagttcacgttcaatgcatgacc

SEQ ID NO: 5195 - DNA, 1426 bp, Zea mays
  misc_feature (1)..(100): optimal_loci_224876_G1, chr6:108117521..108118946, Cluster 32
ggccatatctcaaacatggtagtatgaaacttagaacttgaaagtagtggctgcatccataaggaatgatacatgcttcaaacttagaattcgttggtggcatccatctattattaattgtaaatctagaactatcatgctatctattaattatgctaactatatgtctatgtgtgtgcttttgaaatgaattattttgtctatgtgtatgttattggaatagaccatgttttttgaaatgagcttgttaggctatgccagaaatgatcattagaggtggctatggtacaacagtaaaaactattgcactatcaagcttcatgtgcaatgcccgcacaatcaaactatcaaaagtcataaaaaaatttcaactcaatatattaaagtttaagttataatttcctatattgagagaaatatctactcaatatgaagaatttaaaaatttagatttttctgttttttacatctcttgacataagatgatatattgctagtgcaaataatgaagcacatctacaatgtttttatgaattttcttttaagatttttggtattgtgcttgcacagaaagtttgattgcacaataatttttatcgtgatacagcaaccatctttgtaaaactaatttacatagaggtagctctcgattgcagccacctttgtgaatagatttatagaggtggttggtattttcagatgtcttgatttactagagatggctggacttctgtctcaaaaggatagagacgattaggacagacaatcacgtctatggaggcatctcaaccgctcctacggttagaaatcataccggcgattatcaaataaatatttaaacaatagtaacgaaaaaatgaatctaataccaccgactacttttggtattcttcttcaacaaacaaaacaaaaaacataaaaaatcgtagcgcatcagagagtgcacgtgcatcagaggtgatggatcctaatcattttgatgacaactcctgtataatcgttttaaaaaagatgccaaatgcttctttcctcacgcacgtgcggaggacatacttcgttgtgcacacactagaagccaaaaagattctagacaaactcagatgttgccgcggcggaaggagtaaaaactgagatgttacggttttgggtttcggggattttcacgcttttgggacttagccatttctaacagtctctgtatctgaacttctatctcactttctatttcaatattcacaatatgtaaaatagtattttacatggctaggcctaaggaaacttgtagggaggattggctatagtagtagtcgagacggtggccgaggacaaggcagtgagggcactgctcattggcggtgggaggagctggttagacggtgctagacatccgcgggagaagaatgagagaagcttggtattaccgtga

SEQ ID NO: 5196 - DNA, 1849 bp, Zea mays
  misc_feature (1)..(100): optimal_loci_225100_G1, chr6:109066256..109068104, Cluster 32
aaactactttagccaattcgataggcgtggaatttttcaaagtcataattccctcatttgaactctaaattggatgttctatatatgcattttcattgtattgacaagataaaagtaatagatagaaaaaattgaaggataaaaacatgcgataagggagagggtgaatgagagctaaaaaaactttgcacaagacaatcttgacttgcttcccaaatcatcacctaatcccccaaacaccaaaagtcataaacaagatacactcaagccaacaagtggctagatgttatcagtgatgaccaatgaacacaacggagcattcaaaccaaccaaaaccaagtgcacgagtgaaagtttccaaattctaaaatgagctatctactctaataggaatgaaaaagaaccaaaaccaaaaatagtacaaccaactaatggtttgacgctctgaaaatgtttctagggtatataaaaacccaaagaaacaaacgagtcacaaaatagatatctagaactccagaagcactcaaagcggtgagctacccaagagagtgtgacagtgatacactcacgatcgacactactgttcctagacactactagatgaatcctggtactattgggcctcgacaatactgctccacgcatgttagttccactctgcttgttgcgaccagcccaaaccaaagctcaaaaggcaaaaatgattcaaacaaactacgattgagctgattttttcatacactttcacataggattttaaaggcgtccacaaaatttgagttcaaaaagattaaggcccataggtcgaaaaatatgctctcaaactggggttttctcaaaattagtcaagaggttggattttcgtgttcgagttgaatgtaccaaaaccacttggtgggaatgatccttcgatgtccttgcacatttctatccaaccaaaaagtacttaagaatgtagattgaaaatatccaagagagaagattgagaagggaaaatctaaagtaaaaactttaaaatctcaaaggagcactaaaatggatttcacttcactattaacaatataatagctagcccaatccactcaactagtgccacaagttgtaagaactatatgtgatggactaggagctctctaatgtcacttaagtgacgattcaatggatctaagtatttggggtgtgttttgtagatctcaacatttgtatacaaatgaatggggtgataagattgtggccaaagtcaaccatgagtctatttagagccccaaaggaatctaacccttaccttcttaaagagcatatttctaggacattagacatgtctagtgcaccatcgatatcaacatcagatacatctaatgttgctccaacagatataattccaattgctcaaaactagccattactatgtgttaggtgtccaatacaaacaccagacatggcaccgaataggtctggtgcatgttatagctgatgggcccaaaatacatactccttgagttccctatcccatgtgacgtccagtgctagcgacggaacatccagtgagcactagtactctagaaactcacatcatatgagacatatttgatgcacaccgagcagcgatatgtgaggctaaaaactgttaagaaaatagccttgtgttcggtgcaccaccgctcatgtattgtgcatgcaaaatggctacaccgagagcactcttatctttttagagcagagttggcattttcagagtgctttccataaagattttatgttattctctgaatgtatcacttagacctatatgtgatgcacataattggaacacatagtggcactggatgaccaaattatccaattaagc

SEQ ID NO: 5197 - DNA, 3860 bp, Zea mays
  misc_feature (1)..(100): optimal_loci_225104_G1, chr6:109077261..109081120, Cluster 32
tcggttaccatggtttcatgcttccatttgagctggaaatgtcaatttaaaccacacaatgcttcatatttacaggactaaaactctgtgaattggataactatgagtgaattggattatagatgcacataatcaaaatcctacattaccattctcacatattttccattcaagcaaagttcaataacataaatttgaagaagcaatggttcatacttgctaatagatataagctaaaaattgttgatctattagtgttttagtttgagcggtattttgtaatgttaatttgatgtgtcatgcttcatcttagtaattggactagaactctgtgtgcgaattgggtaactagttataaattgctcctttaatctttatatgcttaccatgtgagagaaatttgtacgagtttgactgtcagctcttttgtggaaactttgtattgatttaaaaaaatttggagcttcgtactaatggaaatccttttttgaatagtatgtgtgaagtgatggatggtcaataagctttgttaattgtttggtattccccgttcatggtgtgtagttgatattttgtaccatcaatttttgcatcacaacggtagcaaatgaggttccatttgttttcacaagtacacatttcatactaatgaaaattttggagcttcatactaatggaaatactttttcatgtgaactccatttgtgttcacacgtacaccttcgaagatacagcgtgtggattacagacatattgttgaaaataacaccatagttttttacattacgtccacatgtctattcctattgtgttactaatcatatcatgtgaactcatagtatgatgcggatcaatgaaagaaatggagatatgatattgatagaaaactccattcatttccatctatattccatttgatcttaaattctttaagtaatctatagtcttataatcattcgggccttttcttgttatcagaattagagaaatgattactacaccaatgcattattgttcttttattttcatttgcatagttattttgagtgccaattgatcttagtaacttagagttatagtttattatttatgctgtcatttaactaactcaagtttgaaattcataacaatgagccatggatatgaattgtacaaaatttagtgtgacttctcttccaacttcaatttcttcatgtcacattcattgtgcgagatggctgacttctgtgtagattattggttgtttctcacatactaaaatgaccatactcttttgaagatatgacatgcacatcaaagaaaatattattaaaattataattgttggatcttttgttaccgttctaaaagtcaaaccttgtagcacatcctttttctaaaataaaaaattattatggacatgctaaaaatattaaatgcaaatattattattggatttacatcccaaaatatccgtatggttataaatttttaatggaagttatagtgtaagagaagttatgtattttcaaatagaggaagtagcatcaacaatgaagatttcatgaccatgactcatcactagcaaccatataataagtatatgtcccaaaatggttagaattaattatgttggattccagtttgaatatgtgaagatgatttgaccaaatagtcttatcgagtttggttcctttttctttgtatcctaaaattattccaagcatatcttgcaaataaatattttcatagtttagaaagcatttaatatgacattaaatattttctacattggtaccatttcaatatggcaatcttgattttcataccagagagaatgtaaccaatatagcatcatctttatactctataaagttagaaagttgcatatagttggtgacactataattgtatgcctagcaactagcatattaatgttagcatggcaatgaaaaataatgactagatgtgatgctacgatgggtcataatgcatccttctagtttaagatgaagtcactaaatttagttgtaataaggttaaagcataaaacttatatgtgcgtcaatagaagtttaaatcttgttattatttagagttattttaaaatctaatggcttaggtacataagttttgtcctagttatcatgccccataaaagttttaattaagccatgaagttggatccatcattttgatgtgtgcactcaaaataaatgatacatggatgtaaaggtcctaaagtttttaaaatggtacctttctcgggtagttgataagcaatatgatggcccaaaatgaatattggtcccttgttttttgctaacaaagcatgacaaaaggaaacacaacaatcaataaggatataattcaacgcttttgttccttgttctttaactccaaattctattgattgaaattcctacgggtgagtttttaataatctaataaactttccattatattgtgctcacataatggatggttataattggtatatcatcaaaagtatattgctggattaagcatatgtgcatacaatttattgtattaaaatttaggaagacaaaatagatttataaaaaatatgtcaacataaagtttagatatatatatatatgtttttgttatgcaaagtaagaatagatctagttcattactaagctcattatcctttgtaaagcaatgttataattagtatgatcataggaccaagataactagacaggtggatagcctataaaaacatcttataatgccacaaaatactagtgtaaagttagttggtataatagatggaccagaagcaaatacttcttctagctctatttcttaataagaaagtctcttaaacaattctagttgctataacactaagttgtttttttatcaagaacgcaaaataacaactacttaaatacactagagagctaacaaaaacaactagtgacaaatataagcttttctgatgttccccaagcaactatcacaagagagaagaatatgggtgtaaaagcaaatgtgatagtgatgaaactaaatcaggcaagtgaacgaacacaatgatttatcgttgaggttcggttacttgctaacaacctacgtatttatatgatgagctcaaactaggtggtttacaagataattggcatcacacataaagcccatagttaggacgtcgtaagaaccacactaaagatacacttctactagcacgattacactagagtttctcttcacgatctaccatggggaatgagcacaagagcctctcaaaatagatgatcagagctgacaacaatctctaatagctgctcaacaatcccatgactttggactgcctaggtgatggcaatcaccaagactaacagagaataacccgtcccagccccttaaatattgccacaagatgcaataactaaatggtatgaacttggagctctccaatctaacccaaacgactataagatgcaagtaggtggaatgtgtatttatccatagtgtataggatgccaagatattaaccaagggtgaccataaggtctacttatagatccataatgaaattcaaccattacttcttaatgggatgaaattaggggcgttagacatgtctgatgcaccatcattgtctacacatgacatatctgatgcactctaaatgactataattccaacaactataaagtagatgttactacgtatcaattatccaatgcacacattgaacaagtctaatgcttgttagagttgatgtgtgcattttacttgctctttgggtgccctatctagtgcggtgtctggtgaaacaacgatgacattaaagcaaatgtgctagtttacatgctctctgagtcccctggtcagtccacaatgtagtg

SEQ ID NO: 5198 - DNA, 1533 bp, Zea mays
  misc_feature (1)..(100): optimal_loci_230858_G1, chr6:138463391..138464923, Cluster 32
gaatccatggtttggaatttcaagaatgttatgtgaatcatggtcacgatgatgctattgattggactgatgagtacatgagattactttgtaaattcttttccaaacatgatagaaaagggaatcaataaaacactcatttgaatgtactaggcttcaccgatgtattggacatgttttttcattctacggggtcatgttgagtaaaaggcaactaaaggataagtgggacaagttgaggggttctatgactacacaagaaaatcaatgaggacgcaaactagacaaggttggaactaggacaaaggaaccatcaacatggaccctaagtggtggaacaagattaaaaatgtgagtgtattattacattgtcatgtatatttgtttattttatcatgccatgtctatttgttctcactttgacttgctgtaggaaattcctaaagttggcaagctcaagaagaggcctctccaaaatgaagatgtcatgacagtgatgtttggggacaacactaatgatgagacattataatcctatgactttcaatcccataattcttttagatgatgatgttatccatgatgaaagagagattgagcaagccactaaagatcacataggtaacaacattgttttttataatggggatgaggttaacaaacttactactatcatgggaaatgctgagaaaaagtcttggatgattctagataagcttaacaagaaacctaagtcaagaacaacacttgttatttaagaacacatttataaatattttggagtgcttccccttttgtatctagtaggaaaggtgggatcaccattaagcaagtaattgaacaagatgtaactcgtggtattgggtataaaaatgatgagcattttgtggcaaccaatttgtttttcatgaaagaccaaaggaaaatgttcatgatgatccccattgatcaaagaatcaacatgcttacgaggaagaacaatgaaatgtatagaaagtgagggtttaattgtgattttttatgaacatttggacatgttttacttacttttaatgatcatttggacatggttccattacttttaatgataatttggaaatgttgtcattaattttaatgatcatttgacatcttaccatttatttgttgttgccattttcttgattgtgtctacatgtcattttttgcatagttctagcgatgagagcggtgaaattttcaatatctttctaggtgattctacgctttcccaaatagattgtgatgtgtacatagataaaaacccaccaacgacatcaaccactcatgacacggggttttgttagagacatgacacaatctaggaatgttgtagtcatacacacctcgaatccgccccatttcaacccctagtgtcatgttcgatggcgcactagacaggttcgatgattttcaacgagcagtgcatacaaacaactactttagtaccaaaaatgaaaacgatgtgacatccagtgatacacctgacacgtccaatgagtgtaaagtgtgtcc

SEQ ID NO: 5199 - DNA, 1685 bp, Zea mays
  misc_feature (1)..(100): optimal_loci_231458_G1, chr6:141043953..141045637, Cluster 32
atgtttttctccatacatgtaataattaagtttcacttttatgagtgcacgaggctatcttctacccttttatctcatcgtaccttctattttaaacttcacactataaacaatgttatcaacgatacggtgcggctatatgcatgatcccttgtgaagacaactttagcctaggaatataatattcactcagtttcaatttacaattcgtttgactttttcacaccaagtttgactagcttgtcttattaaaaaaaattcacagctatataagtatggtggtgtttggttacccacaaattttgagaagttggatattgcacaaaatctggtgcaaattccattatcaacttatgttgggatatatttgtgagatttcggcacaatatccaataaaaaaatcagaaactatttggttcaaaatgagacaattaaatgagataatgataatgaggcacaaaccaaacagagagagagagagtaatataaaatggtggacatgagagtaaaaatatcatatgctaaacgatattattgtaaaaatacataataatcatgatttttttaataagacgacccgaccaaagagagagagagagagtaatataaaatggtggacatgagagtaatgtaacccaagtatgtaactccatgcttatttaacaaaacacactcctctctcgctatcatggtgatcggtgagttttaaatttccaagcatgtcttaagtgcaaactatatttggactaagccagacaattttttggtcgtttctgctatgactatggagctgattggtttcctggatgaggccgaactaggctcccaagatgcagcacctttatacataccatgtttggtttctcaggctgattccaacgatgcaaacaactcttgtttggctgtagctcaacctatctcaaatgatgcaaaagtgacaagtaaacaggctcatgggatacaagattcatctgtgtttctccagagcatggctcgcatgggttcgcttcaactcagccaggccacaaagatacgaggcaaggtgcctcgtccgggaaaccaatcaagtcctatattgctggcgaaatccatgcgacaatgttgtaaagttgtttgaagaataatatgcttttgttataattaaaccattttgatgttttatgtgtgtttgagttttagtagcatggagttcaagttctagcattgtaggaatgcaatgataatacatgatgttaacaaagaataatcattgcttaaatattaactaataaaatatgaaaagaaagctaaagttataacacatagtgggatttggtttagtagtgaaagtgcatctaaactctaagtgggtttgaatggattaaataataatgtgaataaaggataaatgcatttcatgtgatttgaagatattgtcccaattttgaattattgtaaatttgctcaaatgaagcaaatggcatacaaatgggaaatgagtacatgggatattaattaaatgcataaataacaagcatgtgatgaatatgataaaagaggcatggtttgatggttatctgttgatctctcatatgaagcttggtcacatagtacaatatggaaatcagattgcataactgttaaattagcaagcacgtttgtcaagtgaacatgagacataagtaatcacgtgtggggtgatctta

SEQ ID NO: 5200 - DNA, 1626 bp, Zea mays
  misc_feature (1)..(100): optimal_loci_233381_G1, chr6:149682738..149684363, Cluster 32
gttcgtggtattgtgttaccatctgcttttatacccttttatctggcctctgaaagactgaagggccattaccggtgatggcatatactatttgatgatctcgctcatctcttttggcgaggaggcacgtagtacagtgtggatgactggaggccaacgggttgttaacggagacggatcagacgactagaaagacagagtgaacaataggaccaataaatcttttttgcagtctcgtttgtctcctcgttgctacacccaaacctccaaaacactaaaatacatatagttctgttttaatttattatattttagttttttttttaaaaaaaaatagacggcctaaacaatgatatggtctacatcaaagttacaggtatggctgcaatatataacttagtggctccaaatcttttttttaaaaaaaatagaccgtttggagtgcaaatatttattttaaatcctcacgttatgaaattcagatattttttttagaaaaccttgaatgcatggagacatgctttatgtcaaatctgtaatgtttgaagacgcttcaacttcgtagttgttcttttttttattgggattatttaggagcgcctatatttagtaaaacatggtataattacgtaaataaaaaagtacggagtccacgagctacatgtggcaaaaccatgatcagagctattttagatatgcaactcattcgttttttaaaaattatacaatattcgagtttgagggtgttttctagatcgaagataagtttatggagacaaatcagactctgctcaaaaaacgaaaccagcgccaacagaaagcaagtgatcgaaacgatggcggtgcccaggtttagatcgaacactgcgacgcggttagggagagggatggagaaagaaagaaagaaaatggaaaggccctgaaggtctgaaccaggtcgagtagatatttcactggaattgagcagacagcaacggtcttggtttctccggggctctcaccgtaccgttgctgcatcagcgttgcctggtcagctcaggtcagggatagcgctagctctccattaccatgagaggacctgtcagtctctgtgatatctatggtgtgagggggatcggaaacaaagagaaggacaattcatcacgttgtagttttcagtgtcgtgcgaatctagcgacagatgtctcaggaaaatacaagaggcagaaagagtgatctggccggcctggatcatcctgcatatatcatacaagcaatcataatgtcggtaggcccccctactaccacggacatatgtgtgtgtgtgttcgtatttattcagtgtaagaaagtaagtaatgcagtagtcatacgattgtcagtttggattgccggacagtacgtagtttagtacgtatgtccatgcatcgttcaatggtagactgaatttagattaatcacgaaattataacaagttatatgcactaattagtcatcattagtttttgctattagactataattagttgatatccaagagccttttaatcgatgtttaaaatatagactagtaaaccttaactatccaaacaggccggactttatcacatggaagaaaagtcgcaaagacggcgtccaattacgtct

SEQ ID NO: 5201 - DNA, 1538 bp, Zea mays
  misc_feature (1)..(100): optimal_loci_234322_G1, chr6:154082237..154083774, Cluster 32
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(147): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
atatgggccaatgttaatcaatgaaaaacgtggattcatattttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgaaccactcttctccattgcagaaagaagatctggacactgtttgtgctctgttatcatcttcaagctgtagagtattggcttcgctctcagagtcagataaactcgtagaatccttgcttatggacttgtattcatcctactcccgtggtattccttttttatcttactccacaggattagtttatcatgcaatgtccctaaagtcctgtaattttcaaaaaaagttctgtaatttatatttatggttatatctttgttatcatcctacactcctggtaagtacccaaaattgttgccttgttggtacactatatttattgaataattcagtcatgcactactcttctgatttgatattactggatttagatgtaagcatgggttatcctgattgattaaagagagtacctattacaaatctactgtacttgtttctccacaccatgcagaagggtctagtttatgttgttttgttgcttacattttctgttgtttctgattgtttcgtcattttgtgcagactctttgttgcataccggagctgcttgggtccgtattggagagttacgcttccggttattgttgagctcatacagtccagatcctacatttaagtctagatacaagcattcacatattttggaaaaaattacacttgtgaagcttgaggaaaaggtaaaacatctcttgttaccttggtgcatgtcttgaaatctgtattccgaattgtcagtttcatatacttaatgagatgcaaggaagaacatttttttcttgaatacgcatgcaaacaagaacatagatttacagtggcttgcatcatcaattgagctatgttttttcgataaccagttgagctatgcggcatgtatcatcaaattgatattcatctttttaagaaagaaagccaactcttgcgaagaaaagggaaaagactgtcaaatttatagcagctgtgtttttacaggttcgtcatgattgtgaggaattagctggttctaactcccctgaagatagccatgacaacgagttattgcaattgctggaaattaaagagaaagacacccgtgcaaaggtcttattacaattttacatcatgcacttaccgtttcttcttgttcatttctgcattcttgtatatcttcaatcaattaaatatgacgttctagatagggggcaaatcgtttgttttctgttaggttcatttgtctgaaatggcgagtttatttgaccggaggtagcagatattaattctttgcatcttgtgattctacaaaagcttcttgtatttttgttgtttatttggtgaaagcaatggaattgcatgggaaaacaatagattgaccttggggctgtgccactgcagagtacaggtgcatataga

SEQ ID NO: 5202 - DNA, 2006 bp, Zea mays
  misc_feature (1)..(100): optimal_loci_234819_G1, chr6:156394190..156396195, Cluster 32
cctgggtgcctgcagcggaaaagatggcgtcacgtcaccgtgcttttttgaccttggtccgcggcggtaggacggcggcggtggtactgctgttgcaggttcggggcctccgtggggttcgctgctcacagcctcactctccgtggggtactgacgttgatacaagtgacacgcgttttatctatttcagttctataatgtagtagcatttaaaatttatataattttgcactgagactggtaacaaaatattatatatgttctatttttttaaaaacaattaggagtagctgctacctgctagggctattgctaccgcatctttgatcccccctagcttccagatttgttgccgtgtgcggccacgccgagtcgccgacggtgtgcaactgcaaccccaggcccaggccagggcagcagggcgcggcgccgctgccaccatgagcctaggcgacgatgtgacgaacgcggatacgacgggtcagggtcagggcagaggaaacagcagcgccgggatggagagacttgagcggggcagggcaagctgcagaggaaaggaaacagcagatacgatgttcgtcacgtctaacatgaaacgaccagaccacacaaaaaagagccacagctgtttggtttggtgggttagatgcagtagacataatttttatagaacaaaaacgtcgacgactctgtcctgaccttttctttagattatatgctctttcattgacaggacaagaaattggaatttgaagcaacttgttcttttttgctaaatagcatttaagctctgtacaaagtaacgacattacgagaacatatacattcctcctgcatttagtttcatgaagtggttacatttttgttgtgttactcattgttgtctgccccccccccccccccccctaattatgcataattactcctctgcattcccttccttctatttcagacggattttccataaacttccaatttgcctcctgttcttgtgacctcagatgttcatctctacaactgaaaatgaaatgaaatgaaattccattagcttgaacacttttataataatttgagctatgtggactcttggaaggattaatcagcgctgttttgcacaagttatttataccatgtctagatacagacaccttcattcattcacgtgtatttaaacttacagttcttctgatgtgtgctgcaatctatatttgtaacagttacacactattaaagatcaccgctgaaatactacttgcaatagagggaaacacttttttaacaaagttcagcagcctccgattacattattggttcctctttcattttcccaagttttttttcataatcctttacaaatgcgtttgtacatatctaatctctacataaaatttctatcatacaatatcaatacaatgggggaaaaagacacataatgtaacaaagtaaacatgattgttacataagacaaatatgccctaaatcggtaatagcaacttatagtttattctttcaaatttgtactatgcaatgacttcctattgcttccgtactgcatgactacaactagaatggtaatatctcatatatttcatattgcaacaatgtaatatctcctatatttcatattacttaatgcagtatttactcatttgaacctatatattttggatgatgtacaactttgagaatactatcaaaattgtgtgtatatatatcatcgtatcgatgtttgacaaaccagcgtgtgttagccagtcctacatttttaacagaataggacgagttcacaaacttgcccgatgccgctttgaccgcctgtgtgggccctttttgttctccttgggatgcacggcccagctattttttttttgggttaaggcctacctactacgggacgagttcacaaagtagagcacccccgaacttttggttggagagtgcgtggtgtgacaagcagtttgacgtgttgctggctcgagccgtctagcgtaaccagatccaagatc

SEQ ID NO: 5203 - DNA, 3692 bp, Zea mays
  misc_feature (1)..(100): optimal_loci_236832_G1, chr6:166964338..166968029, Cluster 32
ggtgaaactgaagaaagcagcagaaaagcgccatcactatacagtcattgcactttgcagtcaattccattccattccttccttgaagagtaaagagaagaaactaaaccctcggacggacggacgaccgggtcgccatcgctattgactgccagccattctgccatcgacgtcaacacacgagacagcagtacaggagatggaacgacgagtaaggctagacgtgctggaagaagcaacaagacggaccagcagagactagtaagagatcgatccagtagtctcgactactactactgctgtatatggttggttgacggtgcatgcatgaagcactgttatgtatgcaagagtatcttcagtgatagcgcgatggagggctcaaaaagtctcactgttgcatgcatgcactgaacccacaccatccacaatgcaagcaagcatatttccctgttgacctcctagtcctagctagctagcttttccagcattgcttagcctggtagttaaactaaacattaattcatcagatgtactggttcgtacggcactagatctgatactatatatataatttacaattgttaattaagtgctctgctgatgagcgcgctagctatataggtgtgggtcatcaaatcaaagcaattaattaatcaacagagctccatccgatccgtacctactagcaataaaataaacctcctgatgaaaccaaagagagagatcatatatatatgtcagagatcgattattattcaggtcaaccgacaaaactagtgttcaagttcagacctcttgtgtatagcgagctaagatttgactttttgggtctgtgcgtggtggttaatgttgtggcatagtactcgatcaatgtttgtcatcatcagaagccaattgattccagcaaaatgacaataccgagaaggatcagaattgagagctagctctagctgtttggagccggggggttttttttgtgccaaatggaataaaaggaaatgactccacgctgaggaggcccccttagatcgattattctctcacaaagttttcttcgtttgtttttctgaggtgcctagaaattaagtttttataaagtcctctcagttcatctctgtttggcgcttagaggattttggttcgagctcttgcttcgttgcgatcgaattaagttgacagctcatccgcttttaggttttggtgtgattattattattgtcatatgctactagtcatgcatgcatcaccgagagagactacccattgtcattgtctcggtggtaattatgagatttggaattttttagagtttgttatttctgcatacaagtatatggaatggaaagaaatttttgtaattagcttttattgacccgcgttgatggtcgggtcatcaggcgacgacgaggagactcgatctcgttgtaaaggtgacgcgcttgcttgctgttgtgtgtggaacggagaccgacgacgttggttaattcaaaagggaccatgcctttttatttttatatattcccgtcgtcgtccacaggtggtggtggtggtaccggccggaacgtacgttgacgacgacaggcaagcaaggtcgtttcaccggccggtcatcgtccggcgtgtcgacgacggtccatgcacggacgcgccgccgcgtggtagcccagctggtcgctgcgtgcacctggctagactggaggactgctctgctgcaggagtatgtgaaagtctaatgcaagcgattcgggcaaaagaaagcggttcggtccgtccatccacacgtgtatgtattattattgccaccaagacaagaaaagaaaatttgatccgctgagcgaacgaaggagactacagtcttgttcagctacatcgatgggacagccatgagagaagaaaagttcataaaaacaatgtggtatatatataataatatgaaatgtgcatgcgaagggggaaaattaaacctacatttgattcaaagtgctgcttgcattgtattgttgcgcgcgggttaattagaccctaacctaagacacgtacggcgaccgcgacaaacgtcacatatttgtatgtgtctcatcacgttaacttttgacaaggccgcttgtattattaattgttcgactacttgctatactccgtccctcggttaaatcaaatatttgtatgcgttataagttttatgtttctagaatatgtaatgttgtagagattgttactatgcaatgacaatataattgatgatcattttgagaatgaagatcccaaacgccctctattaattaattattacctttttttcatctgtagaattaatacaaattattcagtgtttcagaatgtcaacgtgaagaataagatccaaacatataatatatggcgttgttaattattatgtgtcccttcaacacttgaagagccaagtgttccttccttcaacaatcacacccacggtctgtgactctgtctagctagctactagaaaataaagaatctattacaatccacaaattaatgccagaatctagtagtatatattttttccactcgcccccacacgcatagaaaattagcaacagcagagctgagacgacagcagctagcagcctagcatgcttgttccccccatgcatcacacacgggggtcagatttgtggaattcaaatgtctgcagatgatgatgaaaatacgtacgtgccaataatcttgcattgtcaaatgcgtgtactacagttagtagtctgatcacaattcacacgacaccgtaccgtaacgtttttttcgtgctctcttttcctttattttgtgatctcagctgatgaatttgaaaacatggttgctagcttgtggtcgcacatgctaaaacttttccattttctagaaggaaaaaaaccatcatgtgtccacacccgtcatggaacacactagtgttcctatactgacagctatagaacgcgcgacgacattctcgcgcgcccccattacggccatgctattattaccgctacatatatatatgcatgcatgcatggttccgtaccttttgaaatgtcggattacttttactgttcgaaaaagccattagtcatgtagttaactacattgagagaaaaaaaatcattcggagagatagatcatagtatgatctagagcatatataggatttctagatgcatgagcccatatattatgcgctagtaagataaaatcatggtttcaactttcataatcgtattccactcaacgtacttgattagatagcacgcgcgggcacctgtacacgtacggcggcgacgaggctagccggagacgaagaagacaaagtgtgtgtggaagctttggcttcgggaacgtcggtggggtatggtaccataccatatgtcgttccgacgacggcgaaaaagatggcagctagctttgcctctgggtcctgtggccgtgcaggagaagatgcattgcatttgcagatacgtacgccgtgaacaggtcgtcgatcggatagacaatagctaggacgacgaacggatcatgcatagcggcggctagcttggcgtgtgtgtgtgtgcatggacgacaggaattaattcttagaggcagtgccgcctcattggactgacgtacgcctcgccaacaccgccgtccttcttgcttggcaagcatggagcctcagagcgacgacagtctacgtg

SEQ ID NO: 5204 - DNA, 1480 bp, Zea mays
  misc_feature (1)..(100): optimal_loci_237697_G1, chr7:2969309..2970788, Cluster 32
ttcatctctgaacaggggaggggggcagatttactgctaggagccggacgattgctaaagctctgacggtctgcaatactccctttgttttcatttcttcagaagatcacgactgatgtaaaaaaaatactaacttgattgcagtggccaacataagtaacatttactgtccgaggaccgatatgctatacttaactcgttcgtgatcctatctagaaaatgtgccagaggaggagtccaagtgtgcaatgtttagtctctccaaggtctcctctccaagcctagctagctgctagttaaggttcccttctattcttgtttattgcagggtcaaaacacacccgcagaatccaatgcctagctagcttcatctaaaccaaaggatggatcgagcgcggtagaaggagacaaaaaaaatatatacatctcctttattgcagtgtgcatgcatgcaagtaaaaaacacaaaaggccaatgctacgtgcgccctggacctctcgttcttttttgggtgtgtgcacgctcgtagttgtagagagaggccaggatgggttcttcagtagacattacttatctcctctgctgactagcaggtcctagttatcagaggcctttctctagtgcgcttgcagaccgataaactccaaaggtcgatatcttatcctcgacaagacagttttttttacatctagccctttaaatatagtcgaagacacaactcaaatttaactaaaactaaaacttactctgtagtcccaattaaatttgagtgttataatcgatctctaatcgtttgtttttccttgctaaagtttagtattacatttttttgctaaattttagctaacaaagaaataaactggattgttaaaagtattgtgctaaagtttagcatgtattggcactttaattccaccaaagatgctaaactgcgctaaaagtggtttctcgacccatttctctctcccccacactcgcaagctactttctctctcacccctccccacgctcggccaaccacgttcgtccaccttcggcagctactaaaagagatattaatgtactaaaatttagcatttgtattcaaaacagatctcaaatgctaaagtttagcacccgtagcattatgaaaacaaacaattcctaatgctgttctgcttagtatcgggtcaaaaagctcgaagcggaaaaaggccaggcaaacaaaaggccgggtgatcagcaggctaactaaaagggcggcaaacaaaaggggcttcaggccttcagcttagcacacacggcagaaaaaggacagttttttttccccacagaaaggcgagacgcactacaataatagaccgaccgacgggggcgtttttagtcggtcggtgtgtaatttggcacaaaatacgcatctgttgacgcaacgggagtaatatatcttctctacatcagagagtggttatgaacttataaccactctctgatgtagagagt

SEQ ID NO: 5205 - DNA, 1474 bp, Zea mays
  misc_feature (1)..(100): optimal_loci_239030_G1, chr7:10553403..10554876, Cluster 32
aatcagcaatcatcacggctctaattacaatcgattctaacactagaacgcaaatctacgagtctgggtaaaacaatccttagccaaccgcgccgattgttgcaaagccgccataattatatgctacaagtcttgcttctatagcatcaatgaatgatagtgaatataacatgcacataccaaaaaaaacagagtttggttttcaaacacaatatcatttcccttaagccagatgctccaacacaatgttgttgctctagaagagccaacgactttatatttttttatcttagttggccacccatcctccaatcatgtagttgacactataaggtttatctagattaagagcacccctacacggctacacccaatatattgtgctgcaccgaattagttaatgctttgttagaataacatggtacttcaacaaaccgaaagataggcacaataatacaatacaagataacgtttggtacctgggaggccttgccatgctttcatgggccacacgcatgctttttttttcagcattccatcaatcaaagtgcttgggttcagcacgacggagtgttccttaaatgttgacccttaagtgccgtggaaacgctgaccacagacagcagcatcgcaagttcacgactagtgccaaccaccccagggagactctggtccatgcttcataggtatattcaactacttacttgatagttcactgccactgcacaagccaggagaaacaaaggaaactattaaaaagttaacttacagtcactaaatgaaacagattgcgtatctgaaggaaaaagatacagtagatcaaacttcacgacttcaagttttctggtatgaaaaagcttcataaacatgccagttttcgctaaaatcgtgaatccatccaagctccagatcagtagtacgagattaatgcagccacccacaggggcagagcctcatagacgccatatcgtacaatacattagttacccaatacctctgcaatacatacaataagctgaggtctaataatttagttttcgttaagccctagtgtttcatgtgttcaagtcacagtgttgacatttcatcatgtattgtccccttctcaatgttgctgctacgacttaaattcacacaccaaaaagaaacatcacttttactgccccccacggataaaccgaagtaacataacacacaatgcagccatacttgttttctcgaaaatcgtgaatccatccaagctccagatcagtagcacaagaataatgcagccacctacaggggcagagcctcatggaggccgtactgtacaatacactagttagctaaatacctatgcaatacaataagcttaagtttaataatttggtttccgttaaaccatagtatttcatgtttaaaatggcagtgttggcattccaatatattgcctccttctcaatggtgctactatgacttcaattcacaaacagat

SEQ ID NO: 5206 - DNA, 1671 bp, Zea mays
  misc_feature (1)..(100): optimal_loci_241104_G1, chr7:21129878..21131548, Cluster 32
tgtgcattatgcccatgtgtgttgtattggaatcctcaaggtcgagctcaatcatcttggtttcctccaagggcatggctatggtcgaggtcacaacattcttagatgattagggattatgtaggttacaaccataaacacatgactatgtccaacgtgcaagccagatgccttgaattggagggttgttatgcatgctgtgtggatatcactagtggtatgagaaacagtaggcacaaaatctagaagaccatatgtgcattgtgttagaagggaggaggctactcctactaccctagtagataggaccttgagcatatggtattggtgcccccgcatttgctctagcttggtggacaagttggagttagtaggctagttcatataggatttttcaccaaggagatgcacaactttatttatggtgagcttgtggttacatgtgtacacatatgtatagttaagttatacataaaatcttgatgtaagtcatagtcacacttgtggtgggttcggtcaaccactactatagaaaaaattcacaacaacattttcatatcaattttctaaaaaaactattagagataatgtttcatgttctcaccttcaattcatgcattcacttctagtttgtaacatgaactaatgatgaaacctccttagaccaaaacactcgcctgattaatagtttgagtcagttaccatgatgttcattctatagttgtgaactagatttttttgtcttatgttacttttaaccctcaaatataggttcgattagagattgatgatgtcacaagcaggcaaaggctacattattgcttagagagcatttaagggggttgtgggtaagatttaacggtgagttatgatgtgaaggggagcttcaaagtgagaacattagatactttggagatggagataatgtattatttattgttgcattacttgtgttctacagagccaaactatagtcaaacttctcttatcactagacccccttttattttatattttcacaaaaaatattggttctaaaaattttacaaagaagcaaaagcatcaatttctttgtttggaaactctagtttgcttcaaacacatatagtcaggcatacaactctactatgttgttaccatatatattaatatatttcactataaacccatgggtctaagatgtatgtgccatgcttgcattgttgccaaccgtattttaacaaaggcacaattaaagtgggtttagtgatttctagacccgatttcctcaaagtatgagctaatcctttgaattcccctaacgttcaagaagtcttaatccattactatcaacacaccaattattataatactaaggccaggtacacgtagcaaacatcataacctacctcaaaattaatagtaaaacctcataggttctccttatttcctttttagataatggaatgaatttgattcatcctcaaaatagaggaatctagccacactcaatacggaataggttcaccttcaaatgaccatacaaccaaaacctgatagttcacatgacaatcctaaaacaaaatgctatacatgagagcaaaaaaggtaattatagttgactctagagtagcacatggaaaggtgatgagcgacccagaggcatcactgtgttgtaaccaaggttatatt

SEQ ID NO: 5207 - DNA, 2612 bp, Zea mays
  misc_feature (1)..(100): optimal_loci_242556_G1, chr7:29546984..29549595, Cluster 32
aacaacctgcttggctgccatgtcagcatacctttgtgtttctgcaatctgaggaagaggtaatgatttagcaatactgatatggtcattaatattcatgattgtcttttatcaaagagatttttaagagaacaaaattcctgtgagttgttatactacaaacatgaaagggcaagtaccacaatgccaagagcttgaccagcatactcagcaattggatcaccaaatagtggttcgtcaccaaacgtagaggatgatccaatatttagtcctccacttggaatatcctttgcggaaacaaaagagatgatcttctctgatgctaaagaggatttgaattttatacttttgacataagcaaggggttgtgtgctgtaaataaattctccatagaggcaattctttggagcaggaatatcatccacatatactgcctcccctgtattacacaatagaaaattaaaatcttgctctgcagaaagattaggagaatatgatgataacaatactaaaaactgtaatgtaaccacagaccagatgcttgaagttcaacaccatacttcttaattggttcaccaactggtttatattcgtcactagaaaatgtttctcgacgtgttgataatggcagattacgaacatcatctgtatctgctgaatcagtagaactgctggccagagactttccaggctctgggatgcatttagaaaatggagataggaaactaaagagaaatccaacagctgcactgactctatattcaggatgtgatgttccctccattggtacaaccgtttctctaagtaattgaattgcaccaagtacaactgatgcagtgagtgatttaccagtaaggaattcctccaccctcgttgctctaatagcatgttctgttccatatgcaccaaaagccaaccgcagattactcaatacaagagtatctgattgttcatccaaagaagcatgtcccaggaaagcacaatttacatatgaaacagcattgccaagaggacgaggcgctgctctgtaagtttcaaatagcaaacttatatttgccccggaatctgaaatccaatttggaataaatatgctcaggagtaaagtagtagcatctataggaggctgctctaggaactcttccaaagtaatttgtctccgttctgcaacaacctgaagacaaacagttgcaccagcaccaaggagtatggttgcaatgtccgatggaaatgggaatttttgtgccaaaactatgtttcctccaatactagccgtgttacgaacaaaaggtgtagcaactttgctcatgtggttcgcaagttttctgaaaactacacttccgtttggagaggatatagattcacattcttcctcaagtatctcaatggtcctagagattgatgtagctactccaatttcaattccagaccccatccttacaatatttgaaagttctggaatgcctcctatgtcaatatacttactgtagatgtcttgatccttgtatccaggtacaccactgctagtatttccaacaaccactttgactgagtcactaaataaacaagaatttattaactcgtaatattctttgatacttttcggatgataccaaccctccccggaggctgcaatacaaggattattcagatgatcaagcgaggattttaactcagtttttagaaagtctgggaaggtgcagactccaccaccaagggtgtaacttggcaattcactaacatctgggttcctatcacctttcttccagaatatattaaggcccaaatcctccaagtcaacatctgatgcaaaacttttgcaggcatcaacaattggacgataaccagtgcatctgcacaagttgccagagaaagcctttcctgcttctgatacttttagttttgagaagccctttggtggttcaggcctcttggatttgtcagctttgataagggaagtgaaaatagacatgcacattccaggagtgcagaagccacactgagaggcatgaaacccagacatcctttcctgaacagcatgaaagccatattggctatcacccagaccctcagtagtgataaccgaacagaaatttatagtgtaaagaagtgtcaggcatgaacttgctgtaaattcagtcacttcatccgtctttgggttatattttgctataaggacaacacaagccccacaaccacctgcgataccaattagtgaaaacaagtcatactaaatataccacaaagatgtgcaagaataggctgactgaaagatttgaatctaactgactaaaatatgttgggatttcatttgtctggtaaagattctctattccaaacctgaatttaaaccatagttggtgatttagatataacaaactaattcaatttacaaatcttacaattttaaggactgccgtcaatctctcatgcgggtacaaatatctacatgttttgttttcataagatacttttgaaatagtattttagtggccttatcatgaacttttaagagccttgccaaacaacttctgaatacctgcaatatcacattaactaggcagatagtccgctctctagattcaactccctcccaagtttactggatcgaaaaa

SEQ ID NO: 5208 - DNA, 1594 bp, Zea mays
  misc_feature (1)..(100): optimal_loci_250162_G1, chr7:84695979..84697572, Cluster 32
gatagtcatctctaaaaattaatgattttaagagatacatgactgcataaacaggtaaacctatacgtattggttctgaccgactcccagtcaaggatgaaaatcccaatcgagattcggcgataacccccctttttctcgttcccgatgcatagcgaaatcggatcccaataaacaatttcgattttctcgtttgagtttgttgaagttcaaaaaaaatcagaaaaaaattatataaaaaactagagattatcaagagtttagaaatatatatatatataaaatatatgatttggtatcaaaaatattttttctaaggtaattaacattttagcgaaaatcactctaaatacattgaaaaccacccaaggttagcgaaaaccgtttttcaaatttgaaatcacaacccactcagaaaattgcgaaattcggagaaatttcgttcaattttttgatttcgctgatcgctgagaaaaagctaggaaacgagatggtaaacccggtcacgattcacggatagtttctacagcagtgcggctatcgagcaaaggcgagtagaatataattttttttaaatgcggccggacatatattatttattttactcgttggttccctcaagtaacatggtaatttctggtaggcagtactgtagtacgttgcggagcgaaataatgcatgagccaggaaaaggggaggtgaaacattgaaaaaaagaaaagcatctgcgtgccgtgccgatgccgactgcatggcgactggcgtctggcgagcgagggagggaagggggtgcatgctggtgggtgatgcgcgcgactgtgtcgtacgtcctcggaagtcgtgtgagggtggggcccaccccatctgggaggcacgcaacgcaggtggtcccgtgcatgagttgtgtgtgccgctgcccccccccccctgtccctcctagactctaccgctctagtgtgtatatgccggtccattgtcccctcctggcctaatgcctccaacgcctacctcctgcaaaatttaccgctacacctccggcgcctcgcctgcatatgggcctcctcgtgttgtgttgtgccaaccaaacgtatgcatgtactccaataatggttaccaagtgtcatgtcacaaacaagcatacatccatcctgcaaaatttcgagagatcaaagagtctttaagttagggtgtggaattaatgaatgttgagccaatgagtgacaggtttagaggtacctatattttatggcaggtacatgcatgtggacacgctcaggatggtgaagtggataccagcaggggatctaggtatattttgggtcctctgtcccaactctccggtcattttttccaacaaatattgagatttcctttaaattcagcatcaatcaaaacaaacatgtagtaacgaaggagaatatcaagtgaagtagtactccctttagcctaattagcgaggggcaatgtagttttattttgtttgaaactcgcttggataccatgtatttccttcagaactgagggggtagcatatacactaggaattgaatttatctcattatacatagaggcattgcaaaagaaaaaggagggc

SEQ ID NO: 5209 - DNA, 1594 bp, Zea mays
  misc_feature (1)..(100): optimal_loci_253933_G1, chr7:107241727..107243320, Cluster 32
cgataaaggcatatatgataatcaaattaacattagttttacgatgtgaaggcaatctaaaaatctaaaatgatacaaaaagtcacatagaaaagaggggggggggatggtttgcattgagtctttcaccttctttagacattctattttatatgaaaaaatcatggtactaacataaatgaaggagaagggaggatataaaacaatcctaaaaatatataaccactccaccattctgattcatacaaaaaataacaatgataacataaatgaaagagagatggaagataagggaaaataaacataaatatataaatgatactagagattaatagagggaataaataacaagacatacactaatttaaataaccctctaacatctaaccaatcaattttatttaagtatcaatacaaactaagaaacaataacaagaatatgacataaacattaatctaggtgtataaaggctattaaagatcatataaataattactaattagaactaattttatattttccttgattaacaggactatgtcatttgacgacggtttatggcacaaccttttaacatgtcatatctataagctacaatgcattttttgatatttactaaattgcatctaagtctcaaatgagttataatatatatatataccattaaaagttttcatgaaaatggtatacataaatatatattcttatatcacaagcatataaagaacaaaggcaagatactttgagggtcatgcttaggtcggcacaatatgaagacatgttattgtgtcattggacatgtttgtgtcaaagtaaagacttatcatgtcgtactgacacgacctaatgtgcttcgtgtgcctagaggcgaccacccaaatcagcacaaagcacaagagacgccctagtcccaccactactcattaagggcactccaacctagaaactacctagagtagttggctacctatgttcattaattagggtaccacctagtcaaaaaacaatgatgtcattgaaattataacccgtctcagtgagagtttggtatataagtttcatttgcatttaataagttgccacataaacattttatgacatgaaaatgcctttaagaagcaagagcataagtcggttttatatagataaaactctcttggcatgattatcaactctatataagccacacaattaaatgtttatgaaataatagaatgaagttgagcattgaggataggtgtttcatcttgtttttattcattttacatgatatagtagtcttaggaatagtgccataaaaactcttcattaaaaatggaatgaggagagagagagacaagaaaatggttccttagataaaaaatatgtctacatggaaacgaagatacgaatagatgaagcgataagcatatgacggagagaaaatgtgttattagataaaaatatcctcaagaaactacctattgatttctatatatgtatattgtctttatgatttatatagtatagaaactatgtttgtaggttggaactaccccaaatgtgatgtttggatctttgtttttatatatgtttgaataggaaaccccatga

SEQ ID NO: 5210 - DNA, 1595 bp, Zea mays
  misc_feature (1)..(100): optimal_loci_264246_G1, chr7:162674152..162675746, Cluster 32
tgtaaagcgcgtgagctgtaaatgtctcgcacttttgcatagctaccgtccgtccctactacttggacttcggtgaccgaagctgttgttgtttttttttgttacaaagctcgcagccttacagtgaggatcatctctcctaggtcctagctagcatagaaaatgtaatccacaagcaccagccaagaagccacggttttgtggattatgcgattcggtggggctcgtgtttttggagtaccatcaactgcttcgacttaattcacgtgcgcgtggggggaaaaacacacttggaacaagtagtattttgggagtatcatatatagtgacgacaggtggcataaggaatatgaaccggcgcgcctttaactttcgaaaacccggaatatatctggtgtcactatatatagcatctcttgcatggttgctacctgcatctggagatgatatgcttccgcagtaggcaccgaaagacatatacacagcagtatattttgttggcatgagtgacgtgcgttaaaacgatcgagttactttccaccgcaattcttcgcgcacgcgtgtcatgccgtcgattagcatcttgtaaataataaaccatcctgaagtagtacaatgactgacggtggtatgaagaagtttctgtccacgcacatcttccttaattgtctttggatagtcatcagaatccactgatttttattcgatagagctcgaatggaaacagctatatgtaaattcaaaggtacgcacaatattgcacgtttatctatatgttgtttttattccgcagatctttatttctatagagtatagatcgagaacgtacattctgttgacgcgtgtccacacgcactgtaacggtcggtacgatcaacgtttgcaacagtatttgctgcctgaccggcggatgtagcaaatggcttcaaaatgtattatttttccagtcaaccaaataaaaatataaaatcttagatagagttaacacaggtgatggtgcgggtataaccaataattagacgatacgagtaagagtatatataggtacatagatgtgcacaagagtcgcgcaaaaaaaaagaaaagaaagaaaacgttctgcagcatgcaagagaacgaaactgctgggcgctggtaaaaataatatttgcagtagtacaaatgtacaatatgtacattgaagtacaaactgtgagtacgattactgaatgggccggtgtgatgcttactcttttagtcttttggattcgccctattgccagttaagaaggttcaaggttgtgtggtcgcattctacaaaatgaataactaacgaatgacgacgaccgcgaccaagtaataaaacaattaccaagtgtccgcgtgtttggtgatcgaccagcaaagcaagagccgcgcgctagcgttgcattgggcaggtaccaaaacgcgcgccttttaatgtcatgcatgtgtgtatgagcacgttaattaacttgacttcccatatcacgtaccttccatgtaagtaggacacaacacatgacacaagttacctccatgcatgcacgaccacttgtgcattgactagctagggctcgtcgtccaacgtatag

SEQ ID NO: 5211 - DNA, 1973 bp, Zea mays
  misc_feature (1)..(100): optimal_loci_265384_G1, chr7:169163740..169165712, Cluster 32
ggcaaataaggattgctccctaaaaactgcacagatcctgaagcaacaagtcagcaataaaatgaagaaatgtatgagtagtcaattcatttacttcattcctaccacatatgctttaaggtttaggtgcatatgtaagaattttacattgaggaccatatagatctatactttgtacataccgtactttattctttattttttatcacattagtacaacgttgtattatatctgaataattcaatatatgtgcctactttttttttaaaaaaagataaatttagtgttgaaggctcccactaatgtggttctcaaaaaaggataaaccgatacaagcatttcctttccccacaaatgcggagaggctgcttgaacccatgacatggacaactctcaccgggcccacgcttcagtttttatgtgtattacatatttatttttttgggagtttgaagggggtggggggagagggagatcatgtgcaaatttgagttggttaattacttaatcaatatctttttaattttttactttcatcctgcctagtttcacgcacaggaacagcaaaccatttctattagaaacacattagcttgagataacctatatgccgcctcacatgataaatcagagcactatgcatttgtgggcattttgcatctatgcttcaaggagacaagcacatctacattaagaaccatacactacgaccttgattgattagaaaggtgttcatcggttcgcagtaaattttattattattagcacagaaaggggaccaacagcaaaatgtggtggtcttcagtttacgtggtacaggccacttgcgtaagcaggaaagccagctgaagcgtctcagagcagttgaaggctctcattatgtgttggaaccaccacccccactgtaccagatattatactcactgactgcatcttcatttcctttccatttgtgatacacaacacatgagcctgttcgtggagaataattccttggaaatgcttattctgtccacctcaataaatcgatgcctcgtcacaaatggccctgaatgatgtatagctagcacttgcttttgccgccccagttctgtagaggcatgaaacatgcacgggcatttccttttgtcttggcttcctcgtgagaaactatagcgatggaatccaaaaaacaaaacaaaaaaactccatggatgctaatttgtttttgttggagcaggcaggcaggcaggggagctgagtgagactatgtttctttgactggtagtgggactgcagggtggcctttaggtacggtgtcctcttaaagcggagctttgcataggagctagctactaccactaccagtagtactgtactgcatgcatgctttgataccccccttgcaactaaaatcaacactacactacactagtctctctcatatagtttacccttgtgtccagcttttttgaccagctagcacactgtcattccactagggtaaaaggaagaggccggggatagcgtcaatggccggctggcatttgccaagcctaggcatgattagattccgcaagaaaagccaggaaatgtctatcagtgtgtgtgtaccgtatatatgcccattgctttgctaacctactcgatcgtgtaaataataaactagtaaaagaaaagctggatcgatgatatatttatttcttttggaaacggatgcaggttcagatctgccaagcagtcaatacacactagcaaacaacaggatgaaactgttgtcgtgtatgagcagaagagagagagaggtgagaagagaaggccagggatcggagacggagaggcactgctgcatgtgacaccatgtggagcaacagagttacagaagactaccagacagccaaagaagagcccttggccatgcacttgtgactctctgcacacacacacacactctctctctctaggggagaagagaagcagtacgtaactgtgc

SEQ ID NO: 5212 - DNA, 1765 bp, Zea mays
  misc_feature (1)..(100): optimal_loci_270967_G1, chr8:22828975..22830739, Cluster 32
gaaatttgaaattttttttttcacacggtttctaggtggtgaagcaaacttacctccgtttcaccaaattataagttgttctaactttttagtcgaaacgtttcaaaaacaagcaaatttaacaaccttagataacttagataactttaaaaaaagttatttaacaacctttatttaacagcctaacgtttgttctataactgtttttttatcaaacttagatgactttataaaaaacttagaatgacacgatacattatataaaagcctttttctttcaaaatgggtcattgctgatgggcttgtggaccactgagctttgtacgtgggccatcatctaagaggttaggtggatcgatctaggagttcgaggcgtcacgagcccagcccaacaggccccgtttgggtaggtggacgcattatatcatacactttgttttttttatgtatggttcaattaaaatctagcgattttacgctccttgtcgccgtatcgtttggtgagacaaataaaatttctcaaataatgttaataaatttggaatataatagcatgtaatatcatgtaagtcttgggctgcaacagcaggagtggcccctctaatcttcgctcctaatgaccgggcatggaattggtattcagaactggctcttagttgatcttaggcggtgtttggttcactgaaatataacgcaaacagattatatggagtaagggacaccgatatttttgttgattgagctctttccagtaataggtactactatccgattttaattataactagtaactattaccaccggtaagagatctgattaccatcctcttaacaacttctgaattaaacaacaccttaatcttaaggaaaatatcagaggtcgtggtttgattcgacccatttccattcctagttggcgttgatagcttgttaaaagtatatatgtcagattgtttatcatcctttcgcatcatctcagtctctttagactatatggccggtagattgtggatatagccgttcaaatcattgttttgcactatactatactgtttacatagtactagtttaaaataacaaataaggacgagtaatctggtggaagcatgaattgggctgagagacatgaaccttcgttccatcaggaaggtattggaccgaactagtaacaatgagcatctgcacctaacaccgatagctttcttgtcgagtttctacatgcatgcatcctggatcattaattgttggggtgagattccgaaacatactcaggtattactatagcagctagctagggtgcaatgcatcacgcacatcagcatccatccatcaagcattcagctaataacgcactgcgtcctgcaaaagaaattgtgcgatccattccatggatgggtgtccggttgaaaggcagcttttgctttgcagggtggtgtggtgttttccgttttgctgcgacgggacgggagacacggatcagatgccaaacaactgttactatgcttgctattaaactagctagtcgactttttatactggtcggtgatcacgacgtatatacgtccacaccgatcgatgccttgcctgctaattaataagctcccttgttgctaatctgacacatgacccctatggtatgttccggtcttcagacatctactgctttggtgtgttgacacaggcaatagaatctttttttttttgtaggaaatcgatcaactcgctaattttcagcatgcatgtgttagctatcgaacataagagct

SEQ ID NO: 5213 - DNA, 1614 bp, Zea mays
  misc_feature (1)..(100): optimal_loci_283161_G1, chr8:105321958..105323571, Cluster 32
accaaatcaaccctaatgggttctgcatcactttctactccgctcggaacacgtttcgtgatgtcgtcgttcatggtgatgcgtattatcatgcatgcatgacatggttcttatcacttcgaagcagcatggctttagcttatctgacatgcaccatcttgagaccaatctaatcttcagctagcgctgaagaaccgtgtagctagcgaaggttattatcacctgtggatgcggaagaaacaacgctgcgctattgctacaaaaggtgactactccacagaccacagggctctgcttcgtcattagatgtttcggatacgtctcgttctgcagcgctctagctgcaaccttttgtttcttggcatgtactggaccttttgtttcagtattctgaaagaaaaaaaatacacggaaaggcggcgggtgcagcagttgtgtacgtattcaagaagctctctactgcttcaattgattaattattcaagagtagaagacgagttgtacgtacagagtccagaactttatcacctgatcagacattgggccgggaaaaacaaagcggttccactaaacatctgtcgacatcgtctgtcttgggaataacaaaaaagcaagaagaagaagaaggagaagaagaaaaacaaagcaaaccggacacaagagtggtgacctcgcactcaggctgtattcaaataattgtgccatatattctccaaaactcatgtggtgtctgctacacatatgataacctcagtagagtgctaaaagcaggatgacaaagcactgataataagggccgtatgccaggtaataatcttgtttagattccttgctccaaaaaaccagaaacgatgcggcatgggcattagcaggatttttcatgtcgtcatgcagccggcaatatatgcccaagtgccaaaacatgttgctgaacgcatccccatattgcattcccgattcctgtaaatccaaaccgccctttttttagttgtagatagaggagttcgggagattgaccatggttgttgacacccgggacaagtgtatatagaggagtaaatcttattaaccaagtcaagcggagatacttcagcacttggtgatcgggtcattgggaactagaggtgacatgtgttgtgttgacatcatggagggagcatagaggatatgctactctagagtgatttcgtggtttggaccttaaaatcactatggacggttttttactttgggccttaaaacttgattggagtcatggtggaaactagagaggccacgtggcgtcatcgtgaagtttgcatggacacgaagcaaagtcataaagtcaatggtcatcatttgcatcgatgaagagttgaaccattttgcctataaggttaagtcgtttagcataaaaatatctaaaggctaagttagggggtgtgaaataggctccctaaaaatggtttatgccttttaaccaatcatctatccaccatttttattacctatacttgagtttatgtgtttatgtaggatcgtatgatgctacaataggcaatcagagggggtaaatgattgcaaaagattaaaaatattcatctcaccttctcctaaccacaaaaccgaaatatt

SEQ ID NO: 5214 - DNA, 2201 bp, Zea mays
  misc_feature (1)..(100): optimal_loci_284976_G1, chr8:114821864..114824064, Cluster 32
ggtcggcgcgtatctttcccctgctccctgccgctgcacaaacgtcgtgcgctcgggccgccttgtttccacggacttgccaggctcgcctcacctccgcgcctccgccgtccaacggccaacgcccatccaaaatgcggcatctccgccagcaccaacaagtagcatgcaaaagctctgccaggcccgcacgggcctcgaattaatattttgcgtcctactagtatatatattttctatatttctcccgtacatacaatcctgtcctctgtcctctgctctcctccgaggaagacacataccacaccaccgatgtccgatgcgacgagggagcacataataaaaaaacaataagacaataaaattaaataaaattataaacagagaaaaggacaacgtgaaataccctaggccgtgatcttggcggctgcggcgcgtcggcgatcggcgggggtcgccccgcggccgacgacgtcatgctggggcggcgcggggagatggggtacgaggaaggggagctcgagctggaggagggcgaggcggcctccggcggcggccgtgagctggttattcccgacgcgctcacctgcatcgtaagaacgttctctgctctcctcctcgtcctcctcgtcgtcctattgcgtgtgagagtgtattggatcaatggctgatcagatgtcagtatgcgaatgcgttctcgtgccgaggtgattagtgttgctgtcgcagcgttgcgattgtttttttgttttcttttgcgttacgggtagtatgatatacaagtacttgttaccaatgttgcagagatttaggtcgattttgcagtgtggttgaggtaatcactgattgacacgaatgcatggttgttttttttatcaatgcaacatcaatgcttcaatctaacatggttacatgaatgctgtggggagggggggggggggggggttacgattctgccggttcattgctggcctctgtgggggattcgaatttggctaacttgttagctttacctggtaaagtatcggagccgacatgagaatgcaactatgcaagactagttggtagttacttctgcaaccgttgagtagtagtactagtttgcggtgatttcttgtaccccttgtgtgaattatgaaaccttctcaatttcagtgctagatttagcaggttactgggacaagtttgctggtgattggcagtagtatggtttgtactgttggttcacgtgcacattttctgttccatttgattttggttattttctggttacctgtcctgcttggtgaaaactctgctatgttaacatagatatgtatccgtctgcttccgttctagtttcatccctaggtaggcccttgtactttacaatttataggttggacacaaatcaatttctgctgttgagatcagtgcctagaggcaacatatagacaaaatttatcttctactctgattttttctttgaaaggacttcctagctgacatacgtggggaggtaactcatacatgtttgtatgtattcaagggatttaatatatttgttatatgatagttctggggttacctcgatgtaagtgataatgtgtattttgagggctgaattattccttctaagcttatgcttcaccgctttctattgatagttttacacccagaaagagtgcatttaactttgttgttccatacctgtctatacttcaaaaaagaagaaacggctttctccttttacatacatgctttatctttttagtatacactctcatagtacagcctcatccttctggatgatcagcctttaaacttttacttataactatgttctttgtgctaaaagactaaagcgtgctgtattattcacaggatgaaagaatccaaaatgtgttgggtcatttacgcaagaaatttgaaggtgaaataactcatatgaatttgggtaagaggagtaaaaattgccaacctgtttgctctgtacagttattgatgttatattggcttatgtgaaaaatcgttcacactacataggttcgatgtatggatgccatggttcgttcttgccaacatacccacgttcccctttgggctttcctcaatataggaacactgcagatccaaaaaaccatggcagtgcctcgagatccctgcatgtattaacagaggtacactttacaaaattttacatatattgacttactaggatt

SEQ ID NO: 5215 - DNA, 2046 bp, Zea mays
  misc_feature (1)..(100): optimal_loci_289913_G1, chr8:142359125..142361170, Cluster 32
gccctattgtattattttcatctctaacaattagtcaaaattaattatagtgatgcgtaaatcttcggcttattgaagaagaaaaaaaaagatttgcaaccacgtgcgcttacagctgcctcggtctcttgagatttgagaatgcgcgcttcttggttgttactataaacctagctgtttctcgcatttgatgctgtcatcagtgacggcgtcaaaaccgttgcttgacttatcgttatgaccagccgtagacggttaaggatctgtccccctttcggatcattattattacgtcgattattgtgcacaactgcctgtcaacgcgtgccattgtttctctaaaatgtccatgcttttggcttccaggccaaggctggcagctagagacggagttgagaattttatgcgccggactgatgcgttgaaatgaaaacgcggacgatctttgatttggctgtcctgaaaccgaatggacccgggaggaaagttgcttggatttgtggacgacgggacgggacgggacgggacggcggcggcggcgcggcagtccgttaggcaccaggagatcttctgtgtgcgtgtttttgtcattcatagatttttgagaagttacaataaaatacaatgtaaatcttgttatcagttttatactgacacagaatttaatcgaaaatttttatactgttcggcgagattgtaaagacgagattttaaaaaatgaggtacgaaacagacggacgggcgacgacgacccgaacgagcgtggatgggaaagtgagccgcacctgcacgcaccgcacctactgtctcgatcgcgacaggacactgcttgtacttggggggttgtagcaatggcaattttctcgatcccgtcgcagtcatgcctgctttctcatcttgagaatggaagaagaaacataacgtaacgatactgtttttctctccctccttcctcttttaaataaataaaatgagatataactaaacagctaataaacaggatcaatgccatctttttgtactgtgatggctcagtatttccagtctttagatttcctgacgccacaggtgtgtaatgtaatggttgctattctgtacttaggctaggactccatactatgtcagaacttaaatgcagcattgcattcctttagaagtacgtgcttcaggaaaccgataggagttgcaagaaatgcgacacttggataggaaaccatttgcatctagcagattgatcaatcgttcccttgcttgtcatggaggcttggtcgctttcatcatcatcagattccaatagacacagagtatgtcaaaccatcttcagaatctactctgtcaaaaccatagtatcctgctggtctatcattttccaccttaacgactgctcatgggctaacattgctctccactaactctaatacccgtacctgctagaaagaatttagctcagatgagaaatgaaaacgctatgatttttcttctcaaacacgtacaagcagggcctctgtatcatttcattaaaaaaagaaaagagggcattcagtctctcacaagcttactcgagaaggatacaccatcagacatttcattaaaaagaagcagcagctcgctgcaaggacatggcctctttgatgagaaaaagcaactgtcaaggccggctgctccgtaagcactgaatttgtttagaaaattacctcagcattttctaggacaaagtctgttgcacctgctttcttgagatctaacaaatgcgagagatcttgaggtctatcgtatattggaacctgttgaagcacaaggtattggcaatggagtgttcgttaatttgcatgtccttcactctctctttctctcgaactctaaaaaatagtgttcttgcacaatgctgctaccgtagtgtcgccggcagctcagccgacccttgtggtcggcagctccaattactcccgtggggttggctgctcccctccttcttgtggtcggctgtgtaattataatacatcctagaattaatacacctcacactctttataggattcatgaata

SEQ ID NO: 5216 - DNA, 1514 bp, Zea mays
  misc_feature (1)..(100): optimal_loci_290371_G1, chr8:144727088..144728601, Cluster 32
cactagccttgtagataaatacagtcggcaaagtagtaccaagcactcagcaaaacatcgaattcggtgatggtatagctgcatggcgccgccgccttcgctttcccccacgtgttaaaacagctcaaatatgacgctgtcgttgcacaggcttggcccagttttgtgcgtattattccgcatgctttgtatcgtcggttcgtcacacacatgcataacacgctccacttgtctatatatgttatgctattattatcattggtcacttgtcatcatgtaagaccaaggtcctagaagatcatcaacgtcacctgttgtttgcttcctctctcttttttgttgttatctctaacagtattatatctcttttgtctcttacagtatttacgagagacagtgcgagaagttagacggcatgctaggagatcaggaggttagatgatatactacggcagtctcttgtgttgctcctgtgtcctgctagctagctagcttgggatagtgccattattgctccatatactcatgtgcaacctatcgtagatttatacttgatcttgtaacaattttttctttatttatgcctgaaccgcatggataattatataggaacacgtccgtaggtgcatggtgactgagaatatagtcctcatcatatcttcatctctagtttttcccccggtactacttgtttggacgcgtgcgaaaccgatgcaaatggtttcacaagcagactggaacggcctctagtgttagatgatgctcagtgtcaggacgaactaactcaggatatttatttctaaactagctcatggagatggcgtcgttgtcactcgtcagaccgttgcaagagaagagtaggaggcttagatactcgtgtagttgggccggagcaggcttcataggttggctcagcccatgcggcttactgttcctgagcgaggtagcactgttgtaaataaacaaagattccaaactatttatccaattcctgtccattcctttctatgtggttctctactacttccccgacaaccgctagtaaatcgtgcataccgccagtaaatcgtaatactattttgcacttatattgtactgtctataaagtggaccagtttgaaataagatatgaagacaagtaaactgctgaagatagccaaagaccatatcaatcgctagccagtattggtggtgcagcatatactcagtctgatcaacatgactccaacaaatgagttgaactaggctcggctggtcggccccgtcagtatcgatcgtagtgggattgggtcagtcggtaccgtccgcgacgttgggacaggcaccgttatcgaccataagcagtcgacaacaacggtaggtagttgatgtggaatcttctaattggtcaagactctttcatttatttgaatttacaagaaatccaaaaaatcttgaatctaccctataaatagaggggatgtgcttgggttcattcatgcacattccactccgactcacaagccctcttctcc

SEQ ID NO: 5217 - DNA, 1830 bp, Zea mays
  misc_feature (1)..(100): optimal_loci_290654_G1, chr8:145975797..145977626, Cluster 32
gcaagctttggtagacaaattgatcatcgcccaaggcttaggggcacaaccatgatgcttagatccccgaccttgggggagcctaggccaagcccctacccctatgtccaacctagcactagctcatggccagggagagtcccaagacgggcccgaaagctagctccacaaccctcgaagtgcctctactaaagccaccaaggcacaacaccgtcttttctccatttggttgaggcgatgacgaccacttctcaacagggtcacacaaaaaggtgtgacaaaacaagaaaatggactcaccagacccatggggcaaagggccttaggcccatatgatagtagattcgagcaatgtgggtccttgcataataaggaaacctcaagaaagcacacctgaggaaggaaacaccatacaagacaacccctcatggtcaagcgccaaattgcaccaaagactttaggaagtggttgtgacattattagtgaatgtcaacgcatcgaggcgaatctttaggtttgagaaccacaaaaatcaaagttaaaacgtgaaagatatggggaaatcaagtttagggcaaattttaaatttaaaataaaattctagggattgttctgtgaatatctaaggacacatatgtaattaacattataaacacgaggtccctcatgtaaattaggtcagctaagatggcatgttacatttattaagagctcaggatcacaatcataaaaattgggactttgttgtaatttattttaaattgcatgagatcgtaacaatagcggtggcaacccgtggcatgatgaaatgatgccgacgttaagcaacccctatgcccaaaagcccaatccaaagcaccactcgtgcttaggctctattgggaaaacacagagcagttgaacgggtcctcgctagagtttgggtgatggtggagggacgatgcaccgcgactcaacaagctccaatgagcaattcttcgctcttcggctgatcctcgtgtcctagaatgcaaagtgctactcgcgaactcctcgcgcgatggtgatgctcctactccacttgacaacgtcagaacaatagcatgaacatgagacggctatggtggctctctcggctcgagctctcacggcggtggcgcttaacactcagctgcagggctacttctcattttgcaatggtgcgagtgggtgtcgtggcgtagcttatataggacaggaggcccgttctaggcagggaaaagtggcacatggtcaatagtgagagggagtcaaactcagttgtcgagtttgagtcggttttgaggaggaagacaattttaacgaaccgagcccacaaacacgtgaatgattgttctcgcgtgtaggggcgctaaaccggatcaaaaatgtatcctatcgattacgccattgatgttgcccacacacgggaaagggtaaccagtcgcggtcatgggccgaccgtgtgtcccaatcggctgagaaagggggaacaactgggtcgtggagccaatgtttgagcctgagtacaagttttttttttctttttcagttttcaacttcaaaatccaaaccacaatttcaagatcaaattcaaactcagactcaaacaataaaaacgatgctcatgcatgtaatgcacaagtatacttttatatttctaccatttatttatttgagaaaataagttaaatgaataatccacacaaagctcttattcaaataaatcttttggagaatttatttattttaaaaatatgaaatttaagtgttacatattttatcatttatatctgctataagaaattagtttacaaagcattttaagtagtt

SEQ ID NO: 5218 - DNA, 1417 bp, Zea mays
  misc_feature (1)..(100): optimal_loci_292759_G1, chr8:156914760..156916176, Cluster 32
ataataatagcaaagttgttattagtttatggatcatgcaacccaagcaaggacgtcctatgcgatgcattgctagtcactatccggttgcgaggactaaggagtgagttggtcattgccattgctaatgttaaactctcatgtcgctctcgctcttgctctcactcaatcgtccatataaccaccgattacttaattttcctccatttttgtattttctttcttaactttgtttttccatctcatcaattctatcttttttcaagatataaaaaacaaaagaaccatcttttctatggaatatttcatacaatcgattatgttttacttaatgttggagacgaagggaagaacaatgcataatggcccaaattatatataacttaactaccaaaatagtgactaccttaacttgtacttgaagagtacaaaagatgcctacactatcacttaaatggacttgccatccttagggaggaaaacaaccttccatccaatttttttctcatatgatttgttttactttgatataaatcaagaaatttaaaaattcctcgacctttagggtgatggttccctagcatccaccatgtggaagggctaaaaaggttttatttcacactataaaatattgatcaaaattggtaggcatttattactatagaattttgaaacaaaaataaggaacaaataacatgcaacctcatttggcttgtctgtaatgccaaaaaaatatgtgatgatcaacccaacttttgttaaaaaaataatgagtaacaataaggaaaacgtatcaccaaattcaaaatgtccactgctcccatggtagcccgtgatttttaaatctagacaacttttgattgttagttaccaatggagaggcccatcatatgttaccatccataaaaccatatattcttcaagggtctcatatcaccacacaaaaaaattacatgaaaaagcaacataagttttttattaaagaaaaaaggtttaaagctagtgtagtggcaatatcgtagcacactttaattctctctcctttgtaaactatgtcacaccttcattttgtatgcacttctcttcatcatcctaagatatcacaagatgttaaacattgctagaataaatccatcatgatcaatttcatatatgcatgcttgattattggttgacaccacgcttgttggtaaatttcatcatattgattgtgcgatagacttgcatgtttcaaccagatgaagaaaaatataacatacttgtcaatcctcccgtgaaatctcaccataagatcgagaaaacattaccactacaaattgcatgccagcttaaaaggcaaaagaaaatgcagtagaaagtaccaaacttataccatcttgttaagaaaactttggcagcgaatatgtatgaggtgcat

SEQ ID NO: 5219 - DNA, 1610 bp, Zea mays
  misc_feature (1)..(100): optimal_loci_292938_G1, chr8:157885366..157886975, Cluster 32
ctcggccccacacgaccctctcatttaaaaaaaatagaaccatcatcgtatattaaatttagagagagagagaaagagtatctctcgtagtggagactggagagtgagaatggtagtttcggcgagtgaaaaagaactgttatatcccatcctctattttaagttttactagttaaacaatatcatttacagtataaattttctattttacatgatacagcgttaaaaataaagtctattagatgctgttttttacataaagttttttataaaaaaaaatccatgaagggatcttcttgggacctcttactgcctgttcctatgctatgccatctaatattacctaaaaactaatactaaattatttttcctaacacattacgttaattaactataaacactaaatttcaaaagggggacattcattaataactacaccagatttcaatatggaaaatacttgtccaaacacattacaccaaatatgtgacgccatgtctctttctctctctctcttctgtgccactaatttacagtatacttgttaaagcgactatagattatattcatctaataaacaagcatgtcaacttttcttaacaacccatggaaaataggagagagctccccgtgagtttgatgatgcgatgacccgctatatatagcgacaatggtacgatcgtatattattatacacaaactaataaaaaaaactcggtattgccatctagctagctagctcctctctgcaatgctgacatggcttgccttatagacaagcgcctgcgcccggctatagactatagtactagtactgctggcctggctctcttaattagccctgtcacctccaacgtggactagtgcagctgggctcgcacggggagcagggctgccgggcacacgccggcacgcggcgtccccgttcctccacgctcgccgagcgtgtcgacaccctcacgccagaggtggtgatcgcgcaccactcacaccgagatgcgacggggtagtcagtaatcacggtgcttcgtttttttttaacaaaaaaagaatggcagattaagataagccctagctagcctgagctaggctagatccccctggtggcttattgttagctagctccgtgcatgactctactattggctactagaatatatatcgctgtagctaggaacaataatactaaactgtgttggttagtgcactaatagaattgtcatgtccaaccccatttaatatccaatttcttaaagagtctctagagagttaaaactaaaaaaatacaagagacatactcttcgaggagggcctgtctctacatggttattcataaatattgtctcatgcatttatgaagtgagtaattttaagacacctcattgtattatgaggtttcttaggtgtgtcttatgcttagaacatcgatagattagagtctatatgttgtatatgctctaatatacggtatcttgaggagcctctagggggctatttaaaaaagagatgaactcttcgttaagagctcgtctttatctttacatgattatttttttcatattgtattttaactacatttatagtccgagggatcaacgaaaaggcacata

SEQ ID NO: 5220 - DNA, 2239 bp, Zea mays
  misc_feature (1)..(100): optimal_loci_293246_G1, chr8:159302144..159304382, Cluster 32
tagcaccaaaggtcccgcatggcggaccggtaaaggctcctctgcttctttcctcaagtctacgtagcgagagagacagcctgcctcgtgccttatctaatggcaaaaataggggtgagatattttgtatagcggatgtgggactaggaaggcagcaggaacactagtctcgttcagcaatgctgtctagaaaagtgacaatgtatgtttagtagcacatcggtcggaggctgagggaaggggttgggaataatgtagcctcgctcaacgattgtgtctagaaaaaatggcaatatctgtttggtggcacatcggtcggaggctatgtcagttggaaatggtactttttgaaattttgacaggtcaccactcaaacagacttgcttgttggaaaatcaagcatgagacatgaccataatgtcatttgtgcttttgaattttgatccaacctttgcaaattagtcagcaccagttgatagtattgatgtgaggagcgcgagttctacttgcttcttgtgtctgtagacaccgacccgagtatccgtgaaatacatgaagcatctctgaatcagaaacaccttacttgagtgttttagttaaggctaagtgttttaattccgtaataataaagctctggacttcagttgcgttattatgcatggcgaacagccgaacacaaattaaagtcttgttcgtttgtacgggattgtacctagaatcgttaattccagctgctcaaaatttatatagaaattataaaagcaatcaggttaggatttgttctagtccaccgtttctgaagaaccgaacggggcctaatacaggcttctgtcctaatacaccagtatggattgcttcagaagtggtacaacctcaggtgtcactaccagttttagctctcgggccttcgtatatagaggatatcattagtgcccgatgttatcgacgaccactgctagtgttaagttattagtaacgattgaagactcgttagaatatagattgaccgaataaagttgcatggctagggatgtaggccgcacatgtctttgatcattatgtcaacccaaagcttactaaaataatttagaacggcatgccacttaattattttgaggggaaaatattgaacaacacttctatatataccgagtaaaccaaccaaaaacgcaataggatggttactacagcctaggatgtttacagagcaatatagtctaggagacaggtcatactttggtatatatatacacaacttgtatctacagtacatcaccttagaaagtcaagagagaccatcattttggtttgcggcaaatgcatgctgatgccattttgtgcgtacagatactgtcatcattacttgttattaatctgaagcagatgcaatagtactactacacagtacaggccacctacttccactagtcaaaacatgaattgactcatattaaagagcatatcacccctgtttacttctattgaatctacacagtcaatgtcaaaaccatatatatacatgccaacaatttgattgctctcatctccctttgttgtggtacccaattgaacagtcggtgtctattgtcctctatcgccatagcttctcttgttactactctagtgcgaacaacatgcgaatgcagctagccatggatgctaggaaagggaggcattaggagctacatccgttaggtcagcaacaaatctagcgttccaagacattctgacatgtctctagccacttgtaccgaaatcaatcgactgcaactctcctctagttatctatctgatacttacagttgttgagagtcctatgagccaagaattgaacaaggtgactagatgtccaattcaattttctttcagtttcggcagttatccgttcatttcctgacgaggttgataaaatataatcaagattacaccaaataatatagcagaagagacacggaagcaaaggagcgaagggagcaccgaagtgcaagaaactgcaacatggagatgatgaaacaaacaaagaatgtcacaagttgatcaaactacctccaaaaatcatgatattttgtgtagggttttaaaacataacgataaacacttctaccaaaaaacagcttaatcggagaaggttggaaaaccaatctacgttggtttataaaaccggtctaggttgatttttatattgtagtccatagagaaaaatgtttaaagtcgatcaaacgaatatgaaaagtcttct

SEQ ID NO: 5221 - DNA, 1736 bp, Zea mays
  misc_feature (1)..(100): optimal_loci_294905_G1, chr8:167299767..167301502, Cluster 32
tgatacggagggagtatcatattgttgtctaattcagtctaagttgatgtatctctataatctctgatgaggactattatgtgaaaaacaagagatctctcaactaacaacttgccgactttagttaaagattagaattattgatttttataggccttcaaagaaatttatggaacctaatatgtaactgaaactacacatgaatagtactatgaaaatcaacattatactatatttatgtccaaataatttaacacaggcttactagaattttacataataacattaagacatatgaaagtcacggaagttctttcttccgttgcagcggacggttataaattataatagtgagaagcacgcagatgcaaaaggaagacaaagagggtgtagtagataaaaggaaaaggaggaggccaggactggataaggaaaaatcacttgccaagggaatggaggaagcctgtactgatcagagcccatcgtttcagtttggaagggctggaaacaaatgtgctcgtaggcttgtcgcaggaatataatgcttatgggctcgtctgtgatgtagcccagatcagcccagcggctcaactggtttgaagcacggacgagatgcgagagcacagttaggattttaaagtagcattttcatttttaaatttaaaaatattctaaatatcaaaactataccatggaactgaaagattgcagaaataagtgttttccatccccctaatgggccacagacacctaattgcattttttcaaacttttttcgcagcgggatctcaggacccgccactcaagaagtgactacggtacctacccggctgcccccaagtgagggcttgtttggttattttgaatccatatataagttatttaatcacgtagttacgttaattgacattgtgtattggttatcttttactagatagagtatatatgaggttataaggtacgaaatttgtgtaaaagtttaataactttgaaaactaaattggagcatagataataggacttctcaattctatatatagatgaattgtcacatgtaatgatcgtatggatgtctatacatgagttttgaattaatatatagatggttgtagcgttgttttaatgttaactcggagacacagttcttgaacgtgcaagctatgactatttggttaggcatgtggttattgaagcacatacacaacactaagcaactttggagggtgattggtatcttacaatacttgtgcagatccacaagaagcatgcactgtagttgaaggttttccaagtggtagtgaagcaaaaccacaaggagaagcggatggagaatattattcacttcactctagattctagtacaaactaagaaaaataatgttcacttcacactatatcctagtacaacaacatagtcacatacaaacttagaatagaatgcaacatcatacctacactccacttcctagcaataatcctcttcacctaaatgataaatcgaatggttttctcaatcctcgaaaaagggatggatatggaatcgtacccatccggtaattcttggattgtatggtgtctgtaggccaaggtatcgaccttcaccatgaaggcggttaccaagatgattgccaataagattagtagtgtgtggggacatcctattagattcgatgatgagcgaagttgtatctagtatagaggacacattgtaccattgtcagtacgccgtaattgcg

SEQ ID NO: 5222 - DNA, 1632 bp, Zea mays
  misc_feature (1)..(100): optimal_loci_295705_G1, chr8:170777807..170779438, Cluster 32
attgcagcagtgacgccgcacagttgcattgatagtagaaggcaggagcggagcagagcaagagcatctcttgtggggggaaggggtgttgctttttctgaactgcggtaggatagcagctggacagtggagtcaggttgcacttttgctttgtactgtgttgcctgtgagatcttttgttgacagtgttccataatgctattcccaggaacgcgcgagcgtgatataggggggttagtttgtggggctcgataataatataagtgctaaaagcaccaggactagagccagcgcgattttatttcctgcccgttcaaatggacagataaaagaaaatggtgttactgaatattgtggagtttccctttggaaaagttggagcatgctgcgagacaaatggaggaagaaggcaagtgaaccaccgagattcacgtggaagatggatgtagaagctcccggaagctcggatgggactgaggaacaacgttacaaccctgtttggtagtgctctttctctacgagtttcatctctatgctctacgtactataagaaaacaactctctccatatttttaagaagagctgtaaaaaaagcacactgtttttctttgaaaatatggtgtagtgacgataaagagaaaaacatgagaaaagagtcgatagaagctcttttttctggctccttctcctgctggatttttagatgagctcttccctctttttaggaaaagcccatcaaaaagtctcaactttggtaatttttttcaaaaagtcattgaaggaacttcagatggagccctatcaaaaagggcataaagttctgcgtctctgcctcggaaaatgtattagtgtctgagagtaatttctttaagtgccgttgcgtttagtagccctcttcttgtagctccgggagctattttacaccttcaccaaccaaacggggtcagacaacttcgctccgcctgattctgtattttccgctctctgtagctgtacgagattaagtgaactaaggttagttttaatggattttttttttagaaaaagtccaaattactcctctttgaatttacataaccctttaaaatatttttttagtttagcttaccccctccgtctatttaagtcggttaaagttcaatccaccatttaacaaattttgtattttatttctttatgtacaagagttttcagttcatttttttattaatagctaattccataacttagtcttggaaatatattataatttttcataagtattctaataggttaaggattagatcacaaaaataattttaatgttacaaaaactaaatttaaaatataaaaataacatatctttataatacaactacgctgttcacctcagaaaatataaacttagaggaactgcgcaaatgacgttgggctcgaagggccctagccacaacaaaatagcccaatggaaggcgggccaccaagggaggaaggccatttgatcggcccggcctcgtttcaccaacaggtgttaaattgcccggttttatttctcgcacaaagacaatggtacacgcacatctctctgtctgaccatttattgggtctccttgtacctgatcaaaaaaatcatgagcttacgatcgaaccata

SEQ ID NO: 5223 - DNA, 1532 bp, Zea mays
  misc_feature (1)..(100): optimal_loci_299895_G1, chr9:12798664..12800195, Cluster 32
gattaccgttggagttcgtctaacttaattgaccatgcaattcaatatgatactgcagttatccgttatcaggttcaagtcacggtgagcatgattaaataaaataaaccatacctaacttttattttgagcccgaaagaagcctatacatcacgggagtattgatgtatacgtgaattgtcacaatttttctcatcggcttgagctttgggtccaactgctatatgggcatgcaaacttcctaaaaatcatttcccacaaagctaatttcgatctctcgtgattgtgatttaccaattatttagcatgccattgtacaaacttttcctcttagggttagtttagttattcttctccacgacattattttagcttgtagaggatttaattccctttaatacctttcagctatcttccattgacctccaatgtaatccccaccaaactgaaaaaagcccttatggattaaaataggaagaaaaaaactacaaccccgcccatccatacccatcttcacaactcagtttgtttacgacttcaataacttcttgtaacttatgcgtatggtagccgactgaaggagaactcctatgttgtggcacagttgaaggcatggatctacatacatgtccatatatatgatagaaaccaagtatttatcaaaaggaggtgtagaataacatttaaagaaaggatggtcgtataaaaaaaatagtttggttgttcaatcgaggacttctctcctagttagatagatattcgccacactctattatagagctggtataaaggtggattaggataaataggctagaacctacgccataaccaagagatgaggggagaaccgggatgttatgatgttcggttgtgctatatataagcttgtaatcttttttcatatttatgtccatccatcgacgagaagaaagagatgagttgtaacggcatatggtgtattacgtacactgggaccttaacctcgtgtgttggttttaagtcatgcttatgttcaacataataccggcctgctcccttgtctctcctaaaactcacattcctagtgtcgtttcgcaaccacgttcggaatagagggaccatgtacaaagtataccatctcgaatgaagaaaagttctatataattcaaattgtcatctgccaacataaaccagcagatcctagacgtgttcattattcccaatggaatgtcgtagcagagcaatttcaagggccgtgacgctggagctcatgattagcgatcggataggacaaaaagcattcgatctggaagcaaaacagatcgcgtcgcgtcaaacacgctgttccacgtactactactatagatcttcccgatcttacgctgatataaataccgacagtgcatgcagcagctagcctagctagcatctaaaaaatactgccagctggccccataggcgccacgccacgcatgtagatgtagtacgtacagttcccccgacgctctcaaaaacattcaaaaatcgtcttggaaagatgttaacatatatag

SEQ ID NO: 5224 - DNA, 1810 bp, Zea mays
  misc_feature (1)..(100): optimal_loci_300038_G1, chr9:13760837..13762646, Cluster 32
tttaagaaaattgtatcattttacgtaaaattggatgaagatgatttttttaatacaaaaaatgtctctcgacgagatacacaacttccttattttgagtttttatttgaggttattaagatgctaaaaaaacgacacttcctcaatatattaatcgtgtataagcgcttatcatgttggaaaatgatatcttttcttataccctgtaaaatggatatactttttatatgaaaattttagttgtcactgtgattttcaactttattgttttatttttatttttcgatcgaggttactaagattttcaaaaaataaaacataaagttttagcaccatattaaccgtgtagttgtgtttattatcatagaaaaaaaacatatttttcttatattatatcaaataaagacgcttcttatatataagttgtagattaaataaaagctatatatatctctcgatgatatctacaacattcatataagaaagtatcatcgtttgacccgtaccaaaaagatataattttcataagataacaaactcttgtatgtgattaattaatatgatgttaaaactttatattgtcttttttgagcatatttcaaataaaaaataaaaaaactatagaattgtacgagagctaaaactttatataaaaaaatcatctccatttgacgccatatacaaagctgcaaaattgtacatcagatcgagaactaaaacatttattttttataaaaaaatatctccatctgacaccatattagaaagatgtgattttttttgaagaccataaacgcttgtacgcgattaatatattactgaaaaaaataatttgaaaagaaataattttaaaaaaaataatattcacatgaagatattataggatgtagggttctgcagctcaagacagaataaaggagattataggggtgcagggttctgcagctccaaaccatttctgcacaagcacggtgtttgtgttgaaacctgttgagactgaaaacacgagctcgtagcttgatatcgctatctgcttgtccaaaccaaacatacataggatcgtcatgtcacggctgggctgagctgaggctgatcgaatctgcatcgggggatctcgcgccagacgacgactgcactgggcctctctgcacggcgcgcgccggcctgacgtggcggcacggcagcgtccggcgttccggcccctacggcccccactggcgcatgcgtgagggtgagagagagagaccttgggaggaagagggagatccgagggcggatctttggccggatctcccgatccgcagccctgtggctacacaaaccactctgttcaacagcacgccagcaccaggctgcagatagcagtagcaaacatgatactgtattatagttctattctttctagagcggagtgagtatgtgtgtgtaaaacatgttaagaatatagatgctcatacgcatatataatatacatgctcattcatactgggtttgtttgattttttttctttgcatttgtcttagcctgtattagacctgataatgtagcataacccagaccagcacaaacaaatacactgtcttgttatttggttatcctgcacaagcaaaacacgtacacttggtacaattttatttgattatttgtatttcgttgttgcgtgtagttatctctgtgttctaacacagatctcataattccattagagccaaagcggtgtgacgagcacttcattttttttagtgcgttcattggcatgtgcgaatctacagtgtttcatgaccaaatctggcgtactatagtaatgtt

SEQ ID NO: 5225 - DNA, 1541 bp, Zea mays
  misc_feature (1)..(100): optimal_loci_300478_G1, chr9:16480265..16481805, Cluster 32
gatcgacattatcggtgtccgagagaaatcagacactcgaatactggtaggacgttgtctggaacttcatcaacaaaagatagacccatagtcaacctaatttggtgctattccaaaacatcctaggaccctgtgcctaggtggccaatcctcgtatcggtcatgtctcaagacactacaaaccatatttttacataagtacgcctccaacgctccccaggtcactctagtgcacgacaaacctaacaccacatgcgtctctgactagatcagtcgtgtgccgtcaagtgattgagataaggttttcacccttagcatttatcgtgaggggagacaataccatcagaagacatcaatgtagttatgtatgaggctacatacatacctacaaatactacacagtgcccatggctacaatggttaccaattacgtacgtcatactcgatggtggtgtgaatcgtcaatgtaggcacgcctgatgacgcacgtgtaccgacaaacattgggcaatgtgtgtggctgtgattacaaagccaccaactatattgtactcaatggcaccggctctcgtacctaacactatagcatgtggtacctatggtgtaatccatcatgaaatattgtaaatgtttacatttcttttgtatatgcttttttttgtcaaagttacggaaaacgagctacatattgcaacataggaggaggccgattctgacacttgtgaaaggttattatattgctcttgcattgatcgagtataagacttataattgtatgttaataatgtttcttaatgaaccattgatcctgagtctatctacatatcttttgacacgcagaacacacacgcacattcacactgacctctagctagagtgtagaactgtagatggtagaccgacctacaaacaaactgtacgcatatacgcgcacactaggcgttcaattaagaatttccgaggggattatccacgaaaccacttgcttagtacactagtactcctgctagtcgatctgcgctgcggctcacaagcagactccatatcggtgtagtcgtcagtagtggattcatttcggtgccggttgttgcaccaaacaaacaacaacgaaagccagcagcatcagctcagctgagtttccctgaaacttcggaggtgtcactcgacagcgacagccgtacgtacgcagcggtacatgagttccaagttcggagaaacttccaaaaggattttttttggcgacaacgaacatagaacatgatgcttgtcagcaaggttatatatatatgctaccttcttgacaaggtacatcttggatgcctttgtttccatgcacgacttgctagcttgacctatgcaagagactaggtctgaagctagctatatatcaagctatgcatgtatgcactccagcatggtccatggagctcatgcgcgttggttattaccttttatcttatctaaaagaaagaaaagaatcattccattatctcagttgcgtagaggctgtttgatttcatactttcagcccgtcatcgatt

SEQ ID NO: 5226 - DNA, 1608 bp, Zea mays
  misc_feature (1)..(100): optimal_loci_301721_G1, chr9:23274613..23276220, Cluster 32
cataccatgtgcacaaagagagaaatttggtgtgcaaagtggagcacttagctgatgcactagatatcaataatgtcgttgtttcttctctctttgtgcttacgctgtcatcagaggtggtgcttgtttaacatgcattttcagtgtccttggctggctgctgctgcggctagctagcaggagaaaaatggacgaagaagcaagcaagcaaatcgtcgtccggcctatgtcaccaataatcattaggctatactctggccggtggcaggccagagtgtcgtcaagaacacacctccatcggtgccggtgaacttaaccaccgtcggtagctagcatgcactcgctcttttggttccgccagcagcaataatgcaacgacaagtacgttcgtttttcacgtgagatggatgggtcagtttaatttgcaacatatatatatataataattcctcgtcacttttggtaggggaacagcgacaggaaacgatccatgggtcgcccgctgctcgctttcgaatctaaggtgctaggttttgttatatgcaacaagagcagtcgtccagctcaagcagcacattatttcctagtctcgagacaggttaactacgagctagtagactatattctctctgtgatttggtcttacaatatacgtacctcgtggtacgtgttttattaagacaaaaaattaatataagcagttgcgacacaacaaactctgataagttaaagacactttgaaccaaaattttcctttttttttaccaacggttgtgcacaatctcaaaccaactagaacaataagaaaaagcaagagggtcgagataagtattgatatggcaccaaccgatactaaaggactttttattctatatatttataaattgatattgatggttttatttcaatatattttgatcaaaaaacaacaaatataagtagagatatatagatcatgtcctgggccaggtggcccgaagcatgtatccggtacatatttgatccggtctaaaaataataattaagacgaaagacaaaaaaaaagtaaatccagtagggcacgataacattttagatctgttcctgatcctaagtaataatgtcaagatgaaggagtaggtagtaagagttgtaattattgttggtcaccatattattgttagctagggctgcagcaagcaagtgcccacacacagcagcaacatctaatccgaagtgctgcattgcgcgcgcctttcttcacagaaatcatcatcctagccttttaagctagagtacaaggaccacatgtttattttggaccataagtcaggaagagccgccgtacacagttgcggcgtgcgactccaagttcaaccatgagcttcacacgatcatcatagagcaaattaaaggcttaaagccagccgtttccaacaaatgttgatggatgtctctcttgtataaataccgccgttttgccttgttttcattgaaagttcttgcgcagcctcaagttaactgtttttttttttgcgtaggtcaggtattttcatggtctgtatttgactcgtggattgttacatgtcaaaaactatggctcgtacctacccgtcgtattgattggat

SEQ ID NO: 5227 - DNA, 1619 bp, Zea mays
  misc_feature (1)..(100): optimal_loci_303342_G1, chr9:33708848..33710466, Cluster 32
tagtggctcgcatgtcatgctctagtggcaggtaggaaaatccatgacattgagtatggtgtatcttataaacgatgtagttgcacatgcttttataatgcttgtgagtacacttgtatcgcttggcatgctacacaattattatacccgcacactcctcatagtggccgcatgtccacttgagggcttttgtgtggatatggtgattcttttaaccataactcgtttatcataatagatacgatggacgagaggtttatcttacttgtctggtgtcatatatcatcttgatcagggaagctcatggaatgagggccatgtcacccaaacgacgtcttgagacatatcagagacctttgtggtgccttggaactatggtgttttgaggttttgacctaggatggagaccctagaatctggacaatttgaaacttggcccttacggtggaggatctcgggagttctaggcttgcttttagccgggtccaccatggatttgttttctcctattgaaactttgaaggatactttgcaagcattcaaatatatgaatttccttgaatgttggtagaggttcaaatcattgtatagtggccagcaaaaatgtttggcacagttatgcagtccttttccttttgcttcaacatatcgttctatttaatatagattttgattcagatagttcaataggttaaaaatcgtaaaatgaagcttcaacaaatttaatgtctggttcaatcataataactatggtcgaagcataacgacaccactgctcccacatgctgcctagggcctataccttatgcccctacttttgtgtgctagtgacactatgtgaaggaacaacttcggccaagatgcaataggtggagcaacgagaacacaagtgcctacttaggatactttttattttgtcccaaaactacttgggcagtagggtttcttgagctatgactaggtcatgaacctagactagaggcctttggcctatgttgatccatgtatgccagatagacatgtctcatattaattgtcctctcaactgctcttttattttgtcatacatcctatgtgtttagttctacaaaaatgataagattctgaggcgaagactaacaagaactgacaatggcaagcggatatggtgaggggttatggttaagggtttagggttttagggtgacatgtgcaagtgtacatgtgttactagcattagaaatagcagattgtggagaggtggctctagacaattcaaggagtcaggctgcagacaaggggtcatctattggatgagaggggattaagagttagtgttttgttattataattattgtgcttttgaaattatttttaaaaggctaactccaattttaagtggtggtgttcatgttggaaagcattcgaagttagcatatttgaaaaacttttgtgggaagatctatggagaaggtttttactctcacaagatttatctggtgtcctggggtcaccgaaaaaagtagttgacacccttcgattggttcgagcgtcgctcatctcactaacatgtggcccatcaaatttattcattgcaaccaatgattgaacaccagagaaatagagaatagaccacccct

SEQ ID NO: 5228 - DNA, 2412 bp, Zea mays
  misc_feature (1)..(100): optimal_loci_30422_G1, chr1:187264718..187267129, Cluster 32
atgttattactttttatataaaattagttaaacttaaaagtaagatttaatgactatatacccgttcatttgtttagggatagaaggagtacgaccaactagtccataaaagacagtattgcataggatctttatactcccgattctgtctaacgaccaaaaaatgcgaaaaaagcaatccaagacttgccatcaggtaaagaatatcaagtttacactttgaatgaaaaaacacattattgagaaattttaccgtgcaaaaaaaatttctcaaccagttcgaatcatatcaaaattgttccaagctcatttttgcaaggcaaaactttctacaaacatggtttcttcatccaggctacaaatttggcgtttcgtatatgtttttttgtctcagcaagaggaacaaaagcaatagtgggatccattgtgcattttcacatagttccaaaactagtctatgccaattccttatagcaagtataggattgctttcttttttatatagttttagttgtataaacccacacaaagccttgctttgccaattgtgattgcaatttttagggtttagatatttctctgttatgtctctcaaattttcacacccactggttataaaggaaatagaaacttggggaaactatggatctattttatactcgcgtcaatcctattaagaaagtggggcctctaagcttgatttcgatagaggttttgttcttgtatagccttcactttagacttttctatgtgaatctcatccttgggtttgctagctattctaccaataagactctatagtctccttcacttgctctgtcaattgtgcatttatgccttgtatggtcccatgagcatccaagatggggttgaattgggtgtatggttaaaaaaattcaaacctaggactcaatttaaaacaccattataaacataaactagtctagtaagaggtgcacttaagatttttactattgtggtctaacttgtgctttagctgacaaagagttttgcaacttagagacaatattatcaactattctaaagctaacataggaaggtaaatgtcacataagcaatgtatgggagcaatcaataaatatgctaagtaaagagctaaaaataaagaggcaaaactcatgttgatgcgatgatttatcataacccttgaccatgttgtagctctatggagatatgtcttggttagcaagactcctctagtcatagtgctgtctttccacataatgcttccaccaaccaaatgttagtatgcgagtaacatagcctcaccactaccaccaactcttctaaacaccttgacgtcatgtacactattgagtttctccacagaaggtagggatctcttttcccctacatattaatacaatgtttctccacaacaagaatagatggttgttgccttgaagaagccacactttcactatagggtcacaaagatctcaagcactctagtttaccaaaataaatgaacacgatattccaacactcaaaactatagatctctaaaacctaactgtcatatgaacacactttagtatccatcatagcctttgatgtgatcttgaatctcttcataagataagtttagtgtataaaaacttaccaaaacctgtaacaacctttgagtactttaaacactcaagcaagttaagaaatgtatagtcttcacccttaaaaccattggaaaaaggtttgatcgattttatgcatactaacatattatttgttgggtggtcctcgatactgtatctaattgttggtcttgaccattgccaccacttttaccttcattgaatgatccatgcatcaagttgctcctatggtgcactatatcaattggtgatattgatggtctaggttttcaactatgctagatctctgatatgcataaaatgatccatcaagcatcaagtgattattttatttggcatatcatccggcgggcagtactttcctaaccaacttactagactccaccactttggcatatcatccagcgagcagtactttcctagccaacttactagactccactgtacgaactagcgggcctaataaagttatctggtgcatgctctagtgaggaatcttcattgcttcttcagtatttcaacttggaccttgataaaaaagtaacattgcattcttaggacctattgcgacatttcaaacacatgtttagttctaggcttgtgttgccatctcaactaccaaaagcaaaaagatatgatcatgggcacattagccttacatgctcatatatccactacttccccccccaacaagtagtcgttgaaccgccaaaatccaggaggaagaatcaaagaataaaaatattagaaggtgcttaggacattttaggaggccatcaagtagtgtacttgtttcaaa

SEQ ID NO: 5229 - DNA, 2462 bp, Zea mays
  misc_feature (1)..(100): optimal_loci_30845_G1, chr1:189791722..189794183, Cluster 32
ggtgaatagtgtgaggggacacaacatatgtcactatgatggtggggccaccggccaggtcacccaatatagttagcatcccattccataggcttgacaacctattgtagatgtcactaatgtatatttggtgtggggcacatgccatgatgtccctagctatatgggacacccatgttgtatccttggctttctccttgtatgggtgagagaccgatgccaaaaggttgttttatctgatgagtctgccttgccatagtcgaagcagtcttcttatggctatgctaattcaagttatgatcgctcaatcagacttgtcgagcaactaggggctagtttgcctatcttgtcgtttttcacatgtaactaaggtgcttcatttggtatctggtggtggcacacacgcgcacccactaggtataacccatgattgaggccctggctaactagtagagttagtcagaggctaacccaaattagtaattatggtgtttagtggtgggtttaggtaacccaagttttagatactagtcagttagttagtactctcattatcgagcacaagggcgcccacgatagcgattttcttgtttgtttgaaaaagaataggcgtttacaaacaatgcttgtaacaatattcttatcaaagtttctcccgcactacctcaattgtatgagcaaagatgagaattcccccatgatgagcatatgagcattaagtttaccttatgacatataacattatattaacatctagttggtactacattttgtagtaatttatgtggccatgaaatattttcatatcagagtatacgatatatgcacatagtgaaatttacacgtaaagaagatagatatgtgtgacaaattatccatatcttgtctattctttggactactatcacttatatttttaagtcttttgacatttttgtcctttgactacatcactatatgaaacttacatggaaaaggaattactccactaattcaaccattacatattagaactcctttgacactatatcacaataatagcagcacatacatcatgttaaatacgaaaaatttaggaaattcttcatcatcgtgctcgagaatcttgagctcctaaacttctatacattctagagtatacatatcataatcatgactctagtcttcatatcttattcttggaggactctatcttgcttacaagagtgaacttgattcaattatgtagaacccctacaacaaattatgagaagataaaattaatcgttctattattgtaaaaagggcactacccccgaggtccttatattgaaataactagttttaaatctccagtggtgtgttaaccaaagcaaagtttgcacctaggaggtgcaaaatgtttccatattgagttacaaagtcatcacctttgtgggtagtgaaagctagcatttaaggattccttgttttaaggattttcctaatacatctgactaaaagtcgtgagtttggagttaaagagtggatcgagttcactatagaggcatgagaatgaagttccatcaattctcgatatgaaatgtttccatattgcaattgcaaagtcaccatcttgtgagcattaaaagctagtaggtaaggattcttcattttaattacgaatttacccaatacatctaattacataaaatctctcaaattaggagttgtagagtagatcaatttcactgcagatactagagactgaagttccattagttctcaaacgacatccaacatgtgttatatagtagccctagtagaaagtcataagagcttgttattttccactagagattgcgaaagcacaagctaaacgatctggattgtaaaagactagattgttttagcattctggattgtaggattgtttgatcgtgtcattggttatgcattttctatagtaacacaagtgttatgagtgtataataatgtctttttatccattttgtaacattatttggagtatgttgaattggaaaacaaaaataaaattttaaattatctcatgatcataaagttacttacaaatgatacatgattcgatgaacaaagtgaatctagtctaatataaaaaatacattcaagcatcaaccgatataattcatccaagaagctgaaggcctgaccctctaatactagggttgcagtaattgaaagaaggctaggtaaacaaatgaataccactggtggtctgcaatgatacaactaacattgcaaccaaacttaaacatgctcctataaaggttgtgtgcttacatgaaaagcatccatctattcaaacatgcactagaacttaggtgtggataaacaaggatgaatggttgtaattcaataaaaaaaatacacaaaaccttgaatatgttaccatggggatagtgaaattgaggtggattcataatgtctcatttaagtagtaggtgtctagcaaaacaaacttc

SEQ ID NO: 5230 - DNA, 1748 bp, Zea mays
  misc_feature (1)..(100): optimal_loci_313661_G1, chr9:99367835..99369582, Cluster 32
caactagatcatattacattataaaggtatggtagttcaaaaacattgccctagacttagttcataactcatagtttatagtcatccatcttaaccaacaaagttagagtagcagaagtctttcattaacataatttttgaaataacaatgtgcaggttgtgccacatcctacacatctatgaaacaaggttctctataccactcttggttctcattaaacctgggtgcatataagaaaccataggttgggtggtattacctacaaaaattcaataattatagggtgagtactcaattatactatgcaggatttaccaaatataataatcaagggtaatgcatttggattttcatcaaatcattttatacaagaatgtaaataagaatcttatactaagcattgataaccatagaatggttcaagtaattgtatgcaactttgcaatttggatctcaatcttccacgagtccttatttcattccaactctagtctctatctaaaagtacaaaatttgtaacattaaaaagatagactttgaagaggggtacacattaacaccaccaaatacaaaaggatatcacccatatgacctatcggtacataagggatacctcgatgtctctaccattccctaatccaatcataaatgataataaatagtttgaaaggtgtcaagttaatgacatctcatcttctcacttcaccccgatgccaaatccattggaaaacatgttgtaatcaagtacttgacttgtcacacccatatatgacaagttgtttgtatgattatgttcatgacttgctaccacagatacatggtccttaatcacttaatgagctacaccattcaagacatctcatgtctagccatgttttaaccctcactaactattcactttcattgtcgtattgttggtcaagttttagatcataacttgttaaggttgctagtgaacaaacatgacctagaacatgtgagtgttgagaaacccacgataatcttaacttctaacatctaagaaaacaaagcatgaattattaaaggaacaaaagtaaacaactagcacttgagtggtgtaggaataaatcaagggatgataacccaattaggagacgagagatcatatgctttctaatcatgttgtaacacaatagtgcaataattaaccataatcatattattcaatttgcaaagaaaggcatgcatagggcatgccatgggtaagtttaggtttcctctaagggtagaggtttactcggcaatgacctcctcgattgttgcatcacctaataatgcatgattgggatgaatacaatacataaaagtagatgacatgaaatgatatgcaacaatgtataacatatgggatgcacttatataacacatatgtcaatagtgtacagacatttggttacatcgatgtcctaacaaatgatactatagagcatcaaacaatccatgagatagtttattagattaactttaaaattaggagttgaaccacgcaaatactacatgtgttttgtgaatgctttgctcaaatagattacccttgggttttgggaaaataggacttgagtattattttggtcactccaaaaatctagtgaacaatccttagaacaagtctatatgttctaagtgtttgaagtgtgtagatgttctcttagatggttcatggtgtgggcatacgatctgcaaaaatagcaatatatgtaatataagtgcaagctctctaagtgac

SEQ ID NO: 5231 - DNA, 1716 bp, Zea mays
  misc_feature (1)..(100): optimal_loci_3147_G1, chr1:16042644..16044359, Cluster 32
aattaatatgcgtacatacaaatgaagtattacgccagtacaaacaactgacaagatagtttttttttctcagttccttcttcgatcctattttttcgtctcggtaccttcttctctgtgtttgttctttttttaccctacttttttcgaggcagttacttctttgtctttggtctagggtgaagatgccctttcgccaactagtactgatgcttgtatcagtaccagttttaaaacaagcgaaacaaatattgacggatatggaagacccgttctccagtagtgctagtgctagctttgaaacattatgctcatctcagactgccagtcttgcgcttgtgcattgcaaaaaaagaaaaagaaaaaaagcggtactaacacgcacggtgcgttgcacaattccagattatgaaatagactatggcaatattattattaggttggaggtagattttacctcaaaatctacctctaacttactaataatatgagattatttttcaaccaataataaagccagcatctgctataatccaatgtttccaaactaagaaaaccattgtgttcctcaatccaatatatactgaaatcgtaagtcatactcaaggttacgataatctaatgtggtccatacagggcctaacatatgcatatcatattatcatgtgagcttaatattcctgcccttatttttccgtgtgtaggggtcccccgtcttgctttcctctgaagatctttgtccttctatatctatagtatggaaatagaagacctgcatatgctaagctaggatggcaatgatactagctacccccatttctagggacactaggaagagagcctatactagacggggggaaaagcatggcatatgcaatatagaagtgtgcatttgaggagattagagaatgtgtgcagggtacagaacagtgcagccactctgagctggaagtgctggcttatctttattccatgatgcttatgcttatcggcctcgctctaatagcgtcgcatcgcatgtgtgtgcgtgcgtgtggtccataaagcatagtcgttgtagtacaatgcagcccaccaattggttcagttaagtcctaatcaactttgaagtagctgtctgtgtctccacgcatgtccaaaccggccggccggccccggtcagttgctaaccctgaccccgagttggttgcattgcatcatcgatcggcagctagctttgcctttgcgtgctcgatcaggtttggcctaggtacactgcggtccttgtaattgcagtcatttcatataagcgtcctgaactcatcttgcacaaaaggttcatcgagtgtgcgcccacagcggtgttgtcgtttagcttgcagcaggtgttagggtattaattatctagtggtggatacatccttagacaagaagtgagatcttttttctcataattttattttacttttatcggatgatggatggccgggacaccacgtttggagtggcccaacgacagagctatctggaggtttgattattacgctgaagctggatcgcatgaaccttaccgacaattactccaaacgcgttatcgttttacaccggtgcaatcccgttgttcaggcttccatttcaaaggtgtttccagccttccaggagacgttattattttacaaaccattggagatgtctagctcgtctggctgcggactacaaatgcatcacactaactag

SEQ ID NO: 5232 - DNA, 1947 bp, Zea mays
  misc_feature (1)..(100): optimal_loci_322067_G1, chr9:143898058..143900004, Cluster 32
agctggcagcaaggagggaacaaagtgttgttagttcaggaacagtctgctgtccagttacacatcattcaaaaggaacagaattaccattaccatgcaatcacgcacttgcacaaactatatttggatcatataatactgaggagattgtccagtggaatgattttgcattagctgttgctatgtgggaaaaatattcagaagagttaaagaaacagttgttgacatttttgccatattggttgtccaatgaaaccatttatgttgttgatacctctgagctgcaggtatgtaagaagctgaacaaggatctgatgaattggaattaaataatctatatcacatttcaagctgctttaccttgacctttcctttttagccatgaatgtttttgatttagattgtcgctgttggattaaatgcagctctcaaagagttctgttccatttgaataatctctcttaaaaatggggtactccatctgacccccaataaaagtccataagtccatagagctttcttccaaatgcaccaaatataagtcaatgacatgcgaccttttgatttattctttcatcctcaaatgcatcataaatgcaataaacctgactatagcaatatttgatgggcaatagtgtcattgtacgttttaccttcatttgtgtgctcaagtccacatggacttgtatttggggtccgtaggagtataagacaccatggtaaccagtttgtgctaattgcatttagataatttcatttggcatgatcaagaatcttttacagcacccagtgtatcaaaaggcactaggcgctatttaggtggttgggctctgcgcctctgcctagagactagactttgctaggcgtttatactttttgcgcacagttagaataatgctatgatacatagaggaaaagttgcatatcagaataaaaatatgattttgttatgcatccctgagtaataatcgtaattcatccttttccctctctaattttgccccatttctatgcatgcatcaagccaaaatacctccacacggaaaaagcctagagcaaaacacctaggttctaggcgaggtggtacaacacctatcgccaggggtcgctttattgtgcatgcagtttgaagcttcatcatggaattgtcctgttgtgtgtaattttcatgcttgaggcacccaaatttactaggaagaaccaccctgtggcctgaagcattggcaggccagtggttgggcgaggagatcctctgccgtaacatgggcagacgtagctgcgcacatctggctgacacgtgggcccggccacggcctggccccgcctggcagctgccgggcgttacggcagaggagctgcttgccattggttggttattcctggaaataatatcagctgacaaagttaccacgctgtcttttgctcccataccaacaccagggccacatggttcataatttgttgaatttgtagaaagtattcttaaggtctaatcctatattgcataaatagttcccggtggttggacctgcttgcacatcagcgcatacacattacaactcctgtagtcgctccatgtttctttggcagttaaaccatacacatacaccacattacatccttgcattttttaactttctaatgccacttaccacaatgtctcattcaaatttgatacagagagccgaaccaatctaactctccaatggtgatttggactgcctcattcttatgcgacatagctgtggcgtagatatgtttctctcaagctccactgggaatactggtacaatatatttccatcagcatcgtagaaggtgaattcagcttggtcctggtatagctggatggacatgacccttgcccatcataaaagaacttgagcttgttttcatttggctggaagaatcctctccatgctcttgaacggtctctgcttgtgaagta

SEQ ID NO: 5233 - DNA, 2504 bp, Zea mays
  misc_feature (1)..(100): optimal_loci_322622_G1, chr9:146689836..146692339, Cluster 32
ctcttaagaattgctcaccttgggaaatgagggggatcccaatgggataaggtttataaactaaccctaaccggtgataagcagggactcggtcctttcccttccatagtcttaggatagctttgttgacccttgttcatctatattttagtttcttgtgtcatcgttgaggtggtggcatgattttttagcttctcactacctcgatggcgttcgatctagcatcaacaaaggacccatgcaatgtgagagttttgtcatatctgttgtttcacttccgagtttagcatttcacgtgcttatcagatgaagtttggttagtacaaaaatgatgttaaagcactataattgatgtatccattgcatgattgttacaatggatatgatgatttaccatgatcaaggtttggtaatctgattaacactagggtgttacaatatctcataccaaacacatattagtccatatgtcactcaattgacaaaaaacaaattatggcctttcatatggccttgaccatcaccaccactatactctactcttccttgagtgctgccatcatccctgcattgtctacccccattcaaagccctatatcatcttgattcctactcgaggagctttgctgacatccacacagtgagaggacctaacacctctccattgcgtcaaatgacctaaccagcttttaatatagtggactacacatgtactttgttcctcttgataattatgtaacttatggattaaagggcattgtcatctaagtgagggtgagttaggcttcattcttaaaaactacctggcctctattttctactcaacaaaatatatgcaagatttctatctaaaagtggttttgctaggagctactatttctacaattaaaaatgcatcttggttacaatcctaccactgaccaagcaaaccagagtagaaatgtgctaaggtgtgtggagcaagagaggcttaatgcatttgttgatttatttaaattgtgtgctcgactacaaaaatggtacgtttagatgtaaatatttaagggattgaaattgcatcagatacatatacaaaacatgctttgattgaaaatgtctaacaataccaaatctattgtttggatttatctagaactggcacatcttctcccaactactcctatcaatgacatcaaccacatctctagagctagggaaggaacttgctgaagccaaagaaggagctgcctgagctggggaagaaggagcttcatgaacttggaaaggactaatcgaagctaaaaagagtccacaatagccagacctataaatatgggggaagaaaaaagcttactatagctggggaaggaggtgaccaaccacacatgaattgagaggtttgtgctttctcatgaatgatgaattggggctatcatgaagggaagtgtcaaaggttaagatgacaacataagaagagatgaattcattgggccaatgatagagattcgttgggagccaaaaagcatcgatcaagtgtggcattagggtaggccacatatgagagaggtgtcaagatcagaagaatccaatttcacccaacatagaggggtgaggcgttatatttgatagcccacttctagttatagtacatttacaaggcgttggagttgtagttccaaatctcaataccatggacatccaaatagtttttaggaatcctaatttcaatttctaattctaggctccaatatataaatccaaacaaggtatatgaaatatttgttacataaagtatgtcatgaatcataataaactagagtactaggtgttctccacttgttttgtagtaacaaaactatcatgtgtagttacgtttgttctgatgttggttagtaatgactacatctctacctattaggtatggttttcctaattgtgatatgtgatgtattaataataccaaatataaaatactagaaattagcctctatttaaatgtgataataaaatacataaaatgttggttagtaatgccagttgaatccactaaattgagagtgagtatgacaatatcactcgatagagacctaggaagtgaacctcatgatattagtgagaggtatagtgtcctatagtgataggcatgctctatcactgctaattgacctctgccacttccatatttaattatggcagtgatgttgggtttggatccaatagttaccttagatatggaatatggtcatcctcgactgtgctgctctcatgctttctccacctcaacattaccacaaatgaatgttgcttgcatgagctccctgttaggtttttctcttgccacgacatccacgacacatcaaacgttagactatggaggatatcatctcgtcgacttacaacttttggcttcttcttcagtcacattttgcaatatccaaggaagctactaatcattgtgatggtcctcggtctaatgattggtatagctccaagtgcatgaaaggctagagttctcctattcatgt

SEQ ID NO: 5234 - DNA, 2195 bp, Zea mays
  misc_feature (1)..(100): optimal_loci_323382_G1, chr9:150489168..150491362, Cluster 32
tgtattgttatcgatgatacacgaggatgtatgactactttcactatgtcaccgtgctcgttttccgttatgttgtgcgtctagtaaaaacgacatatgattctctactcatatgttatcttgattaaacatgatagatgtgctagtgcatatatagtgtactcgtttttcctacatttttattagatttgttcttatctgctggcctccaaggaaagcttcactactttgctactggttctttaaccacaagaggagtacgattcacgaagtcaactttactgaaaaataaataaactttgtgaaccatctgtcttatatattaaaaaaaaactgttcgaaggcaagcctgctactgactggaaactactcttgatgttgaactaatagttgttgattggttgaaggagatgctgaccttcaatgattttgttgggcttaatggagtgagtaccaatcatgcatggctattgtctgtgactgtgatgttcaccttcacgtgcgccaaattgagcacaatcaggatccgtgatttcttccgcaatttttttcgtcgcgcgtccgacatgaagaatccattcctgtgattttagccaggattcagggctctggtccgtccaacgaattttcagacagcgatcgctgtcacatatacacatacacaggcaattcataaactgccggatcatacgcactaattttgtcggcgtacgtgtttttaaacttcacgcgatttcatggtttgcttcataaacatctatgtcttgctgcgggcacgcacgcattagttctcttcataacttcatactacgacacagcattcagttcgaaatttgacgctgaaataaaattcggcgtctctgttgctggcggtcagacttgatgacagcgctgacgaagccgaatcttccatgcgcgacgtaaacatcgatcgccttcttcatggagcactagaccagtgcaccaatggcgtggaggtcatgctgtggccaccaattaccatccttttcccccggttttaaaacacaattcggtactagtttttgtcttgaccagggaatttttcttataggctagttccgtcaggaacctggaccactggattagaactaattaatatatgtgtagctttctatgataccatgcaaagatctttcctgcgcatagtgttcccggcatattcgcccctcatggtgacctgccttcattttttttttaaaaaaacaaaggaacatattatgatgactcggtggctcatttgtcaggttttgggattactagcagcctattcggctccgcactgctgctccatagagacgaaatattatagaagttgcagccgcagttggattaaagccacaacaagccgcatcgaacatcatagtgtgagctaatgcgctggccgcactggacactttcaccacttagctgttgtttagcatctttcttatgatgatcttagctgtttgcttagtatttgagtgctactttggtcatgggcttactcagtactagtattgtgatattctattttcgcaaaaggcgtcgttatatactagcaagcaatcaagccaataatctgaattttgttgggagcctggaatgttccagaatatgccgtggctggttaattatgaaaaggaagccaatggtcattgtgcacaagcgtgcttttcctggcgaggagagaaagcaaccgttagctctggtagttagctttactagggcatttactgattgtttggcttgcttttgctgaggaacacaaactgtgttctggcaataaaccattaatctgaatgtacagcgaatgttccaaatgtgctgtgtttcataaattgcacagaccacaaatgaaaatgtcgtgatcattgttcacaagtgttgttttcctgaatcattgatgtgcatatataagatcgagctgcactgaaatgtcatgttttggcaacttgccaagttgcttgataattttttgttaatccggtcagtcactgattagacaaccccctcactccttggggaacaatgtctgggaatttgttatgggcatcatctgcagcataatagccttgatcaggacatgttgtatggtagtattaccatggatggtgcagggcatgtctttctttagatctttacaactttgacagtttttttgtgtttttaagagaagctgctgcccgtttatgtat

SEQ ID NO: 5235 - DNA, 1931 bp, Zea mays
  misc_feature (1)..(100): optimal_loci_32383_G1, chr1:198745221..198747151, Cluster 32
ccttgtagcctctgtgtccttttcttgttcttgtattgaaaagtttactgatggtacttaggtattgttgcatttccattttacctagaagatcatgtgatttttgccaaacctgggcactcttgttagaagggatacaactatattgtactacttgcaaattctagtttatgtttgacagttctatgcgttggcgaaactgctttgtgatgcagtgaatcattcctgcaacctacatcctgcacaacctttccgttcctgcatttgttttcggaaaaatgtgaatagagatatttatttttggacaacaaagttcgattgcagctgatcttcactttggcatgctgtgaacccagtacttcgacttgctaattgaactgttgtgaattagtttaagttgtccaattctgaatttcgttgcatgatctatgttggagagaagttttctgcccgaaggtcctggataaccaaaacaatttcttattgttatatcaggagaaagggattgacatggtttgaaggaccacgaccactaaaaatagaaattgtatatgaacttgatcaccataaatagaaggcccccggataatcaaaacaatttctaattgtatatgaacttgaccactataaatagaaagacagtgcgaccgccagaatagttagtcattctcgtgaaatctgtaatcgacattgccgaggattgttcggtagtgaatttatggggtttcacgagaccgagaactaaaagtaaaggcgcaggagactcgaagatttacacaagttcgagctctcagtgtgagataacatcctacgtcatgtttgtggtggtatctattggctatgcaatgtgattagatgatccgttgtcttagggcgtttaggtcctccttttgtagttcaagtaggggcgtcatttacaaaatatggatctagcccggttacaagatatgaataataaccaaacctagctgattccaccctttttattgggtacctaatctctatctgtgtatgttttcactcttatcaacaaccgggtgttgtcatatgtacatggatatcaatattattatctcctaatctcgtaggatctctagaatatttatctttctagagcttccttgcggatgagatcttactctgattgtgtgtgccgagttactagacactcgattgagcccataaacccacctgttatggcctttcacgttggatatctctaatatatatctttaacagtagcccccgaggcttatttggtcgagttatagggtcaggaagagaatactcggctcttgaatcttcttgtataggtgagccttgctgtgcctaagttgttatctcctttgtcctactaatctctggccctgttattcataaggatgacaacgcgggataggttcgggacgggcagtgggttttttggattcggcgaggatgggaacgggtctacattttctctcggagacgagactagacgaaatcatgagacaaagggaggcgagcccttatagtacaaggtaaacaccatatgatcaatgttcatgggttcaaaaaagaaggcatcactgtttatgggttcttcgaaaaaaaacaccacgcgcgctgcatgtagaccaaactcagcttttggattattggatgagatggacgtaacaacttgcattgctctatttgatcgcatatgcgaacatcgagatccagttgcttattatgctgcttcccatgttagctacacgctgcatacgtacgcaagcgcagtatatccaccaatagattgggagtatcgacgcagtccacaggcgagatctctcctagctctttctttagttaggataaatacaaacccatcatccaatcggcaaccgcggcacgtacgactaaacgttgtttaagggcatatataatgagtatcttaagttgtatcttat

SEQ ID NO: 5236 - DNA, 1718 bp, Zea mays
  misc_feature (1)..(100): optimal_loci_32979_G1, chr1:202154339..202156056, Cluster 32
ccatataataatcgaataaggtcttagaggcttagatggaagagtgaaatggattgatcgagctccagctgaagctagagcaatatgtctttgtacttacggctagcccttggttggcttgaggctgaggagaccgttgggtaatacgattgtagaaattctttaaatgtagctaaaattgcataaaaaacttatcaacgcttgtatctcctaatatatttcactgttgatccaaaatatttattgtacatcataaatattactgttttatatatttaattgaatttaaaaacaacttcttagaaaacgagatattgctatctcggtagcacctggatcgacaggaatgccagcaatctggcagggaaatgaaatgaacatattcctccctgttctgctctgctctttgttgttgcgtgtatgcatccgctgttgtgattgtcagcctctgctacagcaagttcaggcagctcagctaggctttggccaggcaatctggcaacgacaggtcgacagcaagcaagcaaagcggagctgtgaaggcgtggaggtggaatgggactggtgccgtgcctggtggagtagcactcacgtcgccaccatgcacaaccctgcagctggaagctgcagctgaagttgaaagaagagaatgcagcgcatgccatgccacctttctgcagaccggagtcagtccagtcctcgtctgcatctgcaaaagaatcaaactgctgttcctgaagcagcaagccagcaacagcgaaaaagatctccacgccttccactgattcacttgtgtactctggattgtgaaatgaattatgggatttgaagacatcgagtgataagactggtctaatggtcttgtggtttgtttggattctaactggtcctggaagctagcttgtaaagctagattataaaacccgagtttgtggaggtttggaacttggaagcatagattctaaaatttagaattggtaaagttttaaagtaaaaatatccacaataccttcattttttagcatgggtaaatacggagagatatgggaaggcaaaatgtgaagggcataatcgtgttttcaaatctagaagatggaagaagctaacttgcatcagcttatgagcttacaaaaatttgaagctctctgaattctacatccagtgtaaaagctaggcctctttagatccctaactgaattttggaagtcggcttccataatctgctagaaatcaacaaggaattttggaagtcggcttccataatctgtttggttggcttctaattctcttccaaccaaaatcatagaaagccaataattaggcttgcaaagatggctttgccaaagttagggcaaaaaacatagatgttcatttggccaagtgtcatatcaataatagaaagtactttttctctcgggcaatttaagaagtttctagagacttgtccaagctttggccataaattggtgtgctaatcctttggcaatgaaccaattgatgactacaaattttggctagctatgatttgagttgggaaatagttgcaagctaactagaaattatctatggatggctagagggggagggtgaatagcctaataacattttttagaaactcaaaaacattagacaagagtgttagtaaaagagatgatcttaatagccactagcccagcctacacaacacaaagcaagccatatacacaagtctagttgca

SEQ ID NO: 5237 - DNA, 1545 bp, Zea mays
  misc_feature (1)..(100): optimal_loci_33362_G1, chr1:204061627..204063171, Cluster 32
ccacgacctgggtatgtatatatagctaggtatgaacttgcattgatgcaaaccttgaattcatatctaacacgaaattttacttggccatcgtcaccctcatgataaaaaacagagtgaggaggcaaagcagaatgaaaccgacgcgttagaactattctttttaacaaaaggttggaattatatataggctggagtgctagctagctaggtcagcaacattgaacaaatcgatctgaaaccacaataaagaaggcatttatatgaacatacgattattatacacagtatatatatatatatatatccgttgaacgtcaacgcgatattatgatagcatttgactatcgtacaatatatatatcgccgcctcgccgggcatatgacgacgacagttcttcccggccggtgtagttttgtttgtgacgatgggttgacaaacttgtgtttgtgtgtagtgtatatatatgtacagatagatgataggaattacgggtgcacccatcaacgccacgaaatgtacgtacgtataataattccggagcgccctatactcgattatcatgcatctagcgttgtagctagctaggtagctaggtctcatgtattatatatatattgccccaatatagtaatagtataaaccaaaacaagcatgacgtacctgatgtgtatgtacatacatacaaatatatgcatgcatctcgtgaagcaatttgcgggctagctgggtgcatgcaatgtaccaacgacgtaagcaaggttgacaatcagggcgggtcaactgtacatgcacagtcagcacgcacgcatgtcaacactacgtacgtttattcattcatttttttattaataccaattatctatacaaagtccagacaggttttgtcttatcaggggcggcggcctcgccagtgatgatttaaaaaaaaactctagatttgggtatataaaaaatcagatagttggatatgctcaagttctgagttcactactcgatgagtttggtgaaggaaaaaatagctcacgacgcagacgctgcttgtgcaactactctgttatagtaaccatgtgtgtgatttagatttctggaaacttcgatttgattcgtgtagacagtgatgatgataaaacgaagaatcagtctggtttggcaggcaggcagcagaaagtgggggacgatggcccatgggctgcctttcctctaaggcaggacaagaaggcccatatgctgtcttttctccgttacgtggaagacactaatctataggccatgaaggaacgaactgggccagcggcggcggcggccctgaactaaggaaagaggaatcgcgacatccacgtcacgatgtggacgtgttagaattcattcatcatcatgcattcatgcgtgtattattgcacgttggacctggggaccacagcaaagcacgctgtcactgctaatcagcgctgccatagacgatgacaaaattcgcatggccttgaccgtccggagaccgatgctcgcttactccgtagtacaaatccacaaatgccccggcg

SEQ ID NO: 5238 - DNA, 1497 bp, Zea mays
  misc_feature (1)..(100): optimal_loci_337519_G1, chr10:79679052..79680548, Cluster 32
tttttatactctagatttatataataaaatagcatcatttattatatcaagtaagtgttattagatttttcgtttattatatttttatagtatgaacatttaatgtcataaatcttataattctctctctatgattttggttaaacttgagatgcttgctttgactaccaaaggaagtaataatgtaatgatttaggatttggaatagagggggtaccggggtagtactctgtccatcccagaatagtaagtgcattttgatcattaaaatgtcaaatatggtagattttagccattactttctaatactgtacattatcatttacttctataaaatcaatatcatcatacaagcgccatacaaaaggctaatgatacaagttttgtgtcttaaatttatgtataatttaaataattgttggttaaaagtttatattaaattagactttttgaggacaaaatatgattatcatttctggccagagggagtgctagtattcaagaataaatattgagtcaaaagaacctggttccacttaaagataaatgtcttttaacattatggatcaatgctaattaaacaattggtcatattagggtagatgctagggctgcgtatcctgtgcacaagaacttcttcatgcatatgcacaaaatctgtctgaaccttcgttcaatataatgttctacgattgatgtgtttttagaaaaaaaaaacaccttccacgcttcactctccacgcctagctgtatatttgtaaaaaaaatgcgagctcaaaccaaataaagatcgttcatagaagaaggatctagattattgattttgtacatatatatatgcatgaagagaatcttgtgcataggatatatgtttctacctagggcctccaaccagctggtagtttctaatttggtgaatatacagaccagattaccttaagctagctacttatacttacgactactgtagaagcatgctccattgaagggagagttaatgtgctaatggtctcattggacagtcttggtggaagcaggactagtggcaactgctccagtagtagctagggttttgaaaacgagtcaccttgggaacgttggagccaatagctacgccgcggccccccttgaccccttgctggcgacatgtatggccagcaccagcaccagcattgcatgtttccgctgccgcagtcagaggtgtaagactgtacggagtagagtagtgcagagaaggaggtagcagctagctaggactgacaactcgcaagttaagaatgtcctgacttccatgaaattgcacttccccgagatagagcacctataccgcctatgcttttgctagcctgatcaaggcagctagctccaggtctcagcactcagcaggttgaattgttgaccttacaagcatgtttaagcagatgttatacttgggggaaaagattgagatcgtgtttggtatatgtagagcctgggtagctttgacctattttctta

SEQ ID NO: 5239 - DNA, 1531 bp, Zea mays
  misc_feature (1)..(100): optimal_loci_34266_G1, chr1:208728514..208730044, Cluster 32
tcaggtaagggaggagtgacccaccatgatataacaaattttcatactatgatttagccattccttgggttccatctctaatccctacaactatgccatgtgaagccaattgttagtcattgccacctttagctcggaagccaaagtgtcaatagcaggcacatgtcatgtatgcatcctttaacaagatgagacattcctcaagccaagaatccaataattaaataagtggaactttaattaccactgactttttagttggacaattaatatagtaatacttataaattgtgagtgagagctcaggccctaagcgtgcatgataaagccatctcatcgcatacagcgagaaccttgcctgtaatcatcgttgtgtctagatagtttctcctgcatttatgtcatgtctcacatcttgcctttttatgcaggtcgtgtcatgctttaggttcctcacccagtaaatacacacacatagagagagagcgagagaggagaaaaagctttaaataggcctctacacgaatatttaccttttcatatgaacttgcaatatttttccttttgctttcttccactcagtttccctcatgatcttctttgcaatctttactaactgtgatggccacatcttcctctcttgaccatcttcctcatgcgtgtatgttgaacaaggaagtcttggataaggtctaggagattcttggatgggttttgcttctactctccacccaagtccctctagtaaccttcctagtgtggactccttggaaggagactaatgagtacatcatattctagctccatatcatggttgatgtccatttttctctttctggcttttttccatcatagccttgattactacgacctctagcttaggcacctcaggaaaatgtttttatttccctatccacctctgcatgtctctatgaggcatttgtctatgtaaagccatgtgttgcctatttttgccacttcttcaagaagttttacttttagatccatagtgagccttagtgtcagtcttcataaatcatcactaacctctcaaggaagtgggagctagagaaagttttgagtgtatgtattggtttgcctgaactcatatttggagatggaagcggtcgaccaggatcgatggaaagacatccacggcttggatgaaacctaggagctagtgctgcagaaaatcaaagtgcttactagggtagtgctcaccatgatgacccttctgatacatttcttatctcttcacattgcgcgctctagaggcacatcaatgatatgtggcattaagctggtgaatgcgatgagatgcatgctaggatacaacatgagtcgatcttccaccttagcacccttagtgatctagttatgctctacgtcgggtcgatgaaatgctatcgagcccttttagtgtctacactctattcaacgacgataaaacatttgagcaataagtggtggtgatgcctatttgtgtctcaaatggtattgtggccctaacatcaagacattaaccatgggt

SEQ ID NO: 5240 - DNA, 1678 bp, Zea mays
  misc_feature (1)..(100): optimal_loci_343298_G1, chr10:112301324..112303001, Cluster 32
ccatcaagagggtggtggtggacaaccaattgggcggatccaataatacggatgaggagtcatcagaatttttgtccattaggataagagaaggacaagggagaatgaggtgggctataggtagtgaggtcattgataaggtcgatggtatattgggtagcatgcaaggttggtgggagtgggttcttcaaggacgaggaagccatgataacgaaaaaattgtgcaccagtacctataccaatgcgggtcaatgatgtggactcatgagtgtacatgtggttattgtagaccatgtcacctagtagtggaggtgtgaaattacagtggtaacaagcgttatgatatattacattcatcatcgatgagaaatacatgggtgcaaacatggtgggatgatgtgtcaatttggaccatgtgttaattgataaaatgctttggtctttactgtatatttgtatattgttgggtgtgataggagaactgtactttcctctctagaattgtcagtcttatcctatatcgggcacatctagtgatgaggtgtagtgtatatgtttcataagagtacaatatccacttgagtattctatatcattgtcttcatgtcattgatttgaacacatagaaataactatggcttgaatgatttgaaacatccaatatggttgttttagatcttctttgaaagattttgtttcataaaaattccattctaaatcgtattaaatattattatgatcgagatttgtcccttgatattagacattctcttgcttattcactttttctttggtctcttggtgtaagaccttgcttgcccttatgcattgagatgcttgacttacataaagccttgaatctataattaagtattatttgaattttatataattagtatcaataatatatatccagtccatggcaattcctacaagaacttggacaaataatcattagttgtttaaatgttgtcttattttcaccaaaatctcatatatgtgtttattgcagtcatagattacacattcaaagtatggtgggaggctattagttaggtcctttttgtcaatgaaaggagaacaaaggagagaaaatgggtggcaagaggttattgttaggacaagaaaggagtggaatgaagtagtccatgatagaaaatataggaagagtggaaagggttgtgtctgaacccaaaaccaaaggggatggtgatattggatatcaaaataatttatcatagaaatttggttgaaaattggacttggatttgaaaatttggagagttgtgctacccaatgggttcccaccccaaaagcatagtagcacacaaaagataaaaaaaagttgtgccatgtttcgtttaggttttgttcatatttttataaaaaatgatttgattcatgtttccattagttttggattctattcatgtcaaattcattcatttttgtaaaaataaaaattcaaaatgttagtgtttttaacacatgtaaaatacaagatattttagtaataaactcaacatccactagcatataattcctaattttattacaaatggttcttaaaataagattaacttacatatgtactacaaatgatcaacaaatagtaataggtccattatggtttgttttatcaacttcatgaaacccatataggtattgattacgcaaa

SEQ ID NO: 5241 - DNA, 2909 bp, Zea mays
  misc_feature (1)..(100): optimal_loci_3451_G1, chr1:17849900..17852808, Cluster 32
  modified_base (249)..(249): a, c, g, or t
  misc_feature (249)..(348): n is a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
gaatttaattagtgaaactgcatactatggagctacaacagattattgccattcataatgtacacatgtgcttcgtcgtttgtttcttcttttttttttttgcttcgtttgcttcactgatgatgtattgtcctatatgcaatagaagataaatttctcttcaacgcgtgccatgtgtggttcctgctgttttgccagaactggagtctcagccagctggtagcagccaggtaatagtatatgggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttagacgatctagagattcgtctctacgtgatgattacactacgatgacgcccgtggaataataaaaaaaagcaagtaacggctaattaagcagctactagtagtagcttggttgaactgtacgcttgttgtgttaggatgcatgcaccctgatggtgtgtggctgtgtacgacgacaacaagacgtactgctgctgtgcctgtattatattatacttatataatagatggaaacaatgcgtgttaattagtgctcgattatgctagctagcttttggtaacgtgcgccggagaccaaaaaaacgttttgctattccctgtcaccttttttcgtcaaaaaaaatctctctcgatagtaaccagttgattcttgattggacgccaaatcctgcccgttgcgcccaaatgaagaccaatcactgcaaagttgcgcccgcgcgcccgcgagtggcctgtgcctgtgcacttggtagttggtggtgctctagtataatagcgcgttggtcgtcagttggtgcgatctaactgaaatgccttctccttctggcttctgctatattgagagtgcggctgactaatgtcctcccgtaaaaattcaaacaatgttgctgtggttggtagcattatcactttcctgtttcgatacatgcatgcatgtgtatcggtcactattaactgtacagctgcacgctcacatatccggaacagcacttttgaatacaagtgccacatttcacacagcctgcagtacgcctgaatttcaggtgaaagttcacacccgccgttattatggaaaaagtacgtagcaaatatgcaaagtaaacaaaaacactcgatattcaaactcgttttgtagaacaaaaaatagagggagagagaccatggttcatctatatatatgtatcttgttgggaaaacctgatactcaaactcaatgtataaaaaaaatcatgccaaactggcaaatcttagttgcatgtatactttttttttaaaaaaaaagatccgaccctgacataagaaataagcgttttacagctatacatgcaaaacgcacaaggaccacctcagcacgataaagagaatgtgattacatcaaagtgggtcactctatgagttgcacaatctttaaaaatgaaaggattttgcccccgctagattccacattttacgctcacatccaccaacatcaacaataaggcatgtactatcatctgacatcgttcaaaaatttgatcattcctttgccgccaatggtccatagtattagaatcaccaagctatgtacactctagcttgtctcaagaaccacaaccctatgttcttctccgccacttttccagttggctggtctttgctattgtttgttgctctctcttgctggttgctcccatggtgctctagggttgtaagatatatgttcatagtttgatgccgatttggcaatagtagaaaaaagaagaatttgcacctaagtggtgcccacgatttgcgggaaggtgggttggatttgtcttttaaattgtatcttatacatcgaaggttgccaagtaattgtcgtctgattctagtgttcattttctcatcatcaatgtttccctggttgcaattatattgttgtacaagatcccacttgttgtgtttgaaaagaaggggataatattgttgttgattgttgccccattctagtaagattgctaagaggtggccctttcccgttatgaacctccactttcatagcagacacagagcgctttgtcaaccccgtctattggtagtttcattcctatccacattcattctagatttttccatgagaaccacaactgccacagtcaaagcgctatgctaaatttgtgaaagtcgatgattcctagcccccatactcaaatggctttgagacttgtccaaccaacctttcttttctcttgttagtatactagctatatccaacccgtaacaagtgacaccatgcattgtcaaagtatgctaatatcacacctgattttaaggacaataagcatgatatttcttcttcttcttcttcttgaatgtcatcttttttccatctttgtcttccttactttctttcctctcttcattattttgtgaacacttagcaataagatgctccttgctcccacatttgtaacatcttctttattcttttctcttcgaacaagattttctccttcttgcacaacaaactttattcttcatgaactttccaaaatgaagcacaaaaagagacatctcttcatcttcatcatttgaacttgagttttcttcttcacttgattcttcttcttcttattactcttgcctttggatgaggtggtggctttgagtgccacacttttattcttcttaatctcaacttcattttctttctcgtcccttttcacatggtatgtgtcttatgtgaaaatgtcacaggtacttggtttggggtcactccattgagaccgtatctcacaacaataatgaccaatatatcaaattgtgagggtaagcatcttagaaaccaatgagagaaattatcatcgcccactttgtgtc

SEQ ID NO: 5242 - DNA, 2082 bp, Zea mays
  misc_feature (1)..(100): optimal_loci_34621_G1, chr1:210669489..210671570, Cluster 32
gattttacgatgtatatattaacactgcaagaaaatcatgtcaaactagcaaactacctagtatggcaacttacttttttctctcgtggtgggtaatagatgacaaactaacaaatttagataaagccaaattcaccgctcttgggtatcttgatccttttacctctccgtgtgataatatttacaaatgaaaaaaatacactaacatataaacataggtttctagcttaaaagagaactaaacacacatatattagcaccttatttttaaccataccgagttttattacaacctggcccaatattctacacaaaaggaaaactttgtccaacatttaagaggaacaaagtgcaacacaaagaaggatcaagttctggtttgcatgagttgcaaggtgtccatataaatgtctccatagagtggaatgggttaccacaacaaaatatggatttatgcaactatcctcacattgtggaacgagcccaataagacatgcaccaagttttcctttgattcaccatgttcttattttcctcctctcttttacatatcactgaatgaattttattttaccagattttttatgttttcttttttgtgtcggggccagggctaggtttgcctaatgagaggcatatttgtgtgtagtggcattgaacaactcatgaaacattttatattatgtacaattttaagacaccttaaaatatggtatatgtttaatatagaaaaagttatttttagtggtaacatagctatgtagtcaatgctcaagttatcctcagaacattgtgtaaggatgaatatatatttggatagtgtagagtacatttgaaaggcgtgatgttggtacaaacttggtgctatataggcatgtgtgttctcatatgacacaaaccatgtaatggtatatctactttttatgccttctttagcattattacaatacatggccaacaaacacctctatacaaatatgggtaataacaaagcaaaccacgtgaggggttagtatattatcgaagttccatgtgtattatcccttctcaatcggttataatttagaattgttcccccaaaataaactactggtatgacaaatttacatccctctctttgtgaaaaatattcacaaaccaaaaaataatacactaatgtatcattttaggtttctaacctaaaagagaaaaacatgcatatgttagtaccttatttttatacatattaagttttattgatacaactctgcccaacgttcttcgcaaatggaaaactttatcaaacttttaaaaggagcaaagtgcaatccaaaggaccaattcctggttttgcatcagttttagggtgtgtatataatttcctctagagaatgcaatggattatccacaataaaatatggatatacgcaactacccttgaactatggaacaagctcaataagacaaacacccacttttccttcaatgccaaatagttttatgatgtttttattttatttctattttgtgtgggatgagggacacggctaggtttgcctgacgtgagacagtttgcatgtagtaccattgaacaactcgtgtaaacattttgtgttatgtgtagtttcatggcaccttaaaaatatggcacatgtttaatgtagaaacaaagtcatttttagtggtaacttatctatatagtcaatgcttacatcactcgtagaacattttataaggatacatttatatctggatattgtatggtacatttgaaaggtgtgatgttggtacaatcttggtgctacataggtatgtatgttctcatatgacacaaccatgtaatgctatgtctctattttatgccttctactaacattattaaaatacatggccgacgaactcctctgcatgaacatgtgggaactaatgaagcaagtctcattagaggataatagatgattgaattttggtatgcgtcatcacttgtattttcaaattgttacaattaaaaactattccctcataataaacttctagtgtgacaaatttacatccctctctatggtacaatatttttaaagcaaaagttatcacactgacata

SEQ ID NO: 5243 - DNA, 1422 bp, Zea mays
  misc_feature (1)..(100): optimal_loci_35280_G1, chr1:213915175..213916596, Cluster 32
gtgcatagaccttcacgtgttaggtgtcttttgtcacttctcatcttattcatctttctcttagagttttggttgactatttagtttgtctattttgcatggactattagctgacaatttatatttcagccaagtgtactttcttaaaaaaagtgggtcgcatggtgatcaattgaaggaactttcttttatgctttgaatttttcttaacatatacattgggtataatcctgcccttctgtttcagtacactcggacatgtacttccaaattcgtgcaaattacccttaaacccttttgatactattgcaagttaacctatgtacttctgtaatgttgctcagctgtacaatgcattggacacgttgagtatctgattgatcatagaaaacatgtgctgtactgagtttcatgtcttatgtaatttgtgatttcattgtggctacattagtatgttttcacttgctttgaaattatagatgatcagtttgcaaacttagaagtacagatggtatttgttttttgcaaataaggtaagctaaatcatctcaattaaaggcactgcttgaaatctggactgtggaattctgaacgtaatgtttccttgaggcacatggcagttcgcagaattactatgaccactaaagttttcttttcagggatgcaacaagctgtcaaactaagtggtgctgtcttccactagcactaggggttgatctgttttgaaaaggccatgtgccgagggaaggacctgtactatggtctcaataatgcaatgttgcatagttattccattgggtcatggttgtcatttcttccttcgctgcgaggtcagtgttttgtcttttgccttcctgttcaattggtgcgtccacttgttttgaaatttacatgaccccataacaaatcaacagtgtcaatactcaatatatcacaatgtttcttttcagtctctcatgagacaatttcaatatcttttttcatgcccctgtagtcaaggtacttttgtgtcatataatttttctggttaaaaatacctgttctctcgaataacatttacctttatctgttttttctgacatgcttctgttaactgttcatcttttggtactgctttgtagttactaaagatcataatctttttaatttttctggacagtgtaatggatgctatctacatttttattggcattctaaatggatgataactttgtatctgctgttgagtcactatagatttctttattggaaagttgcaaagccaccaaagtatcacttgagttttgagattccaccccataacactttttattccaaaaaccaccccaacatatatgcactgagttgatttcacgcatttttgccatcctgaagcaactggtgtattcgttattgaagttagatactctaaaagtacaagcc

SEQ ID NO: 5244 - DNA, 1879 bp, Zea mays
  misc_feature (1)..(100): optimal_loci_35343_G1, chr1:214304672..214306550, Cluster 32
tatagttgaaacggcagatagacacaactaatcatagagatctgatgccatacatcggtttcgcacaaggagaggaggaagttttctttagtaccttcgtcggttcacttaaaaatctggggcttgtcctagatgttcaggcaacaccgacatcccccgtacaagcttcagaagatccaatctacacttcgactcgttttaactgttagctaactaaaaattaggtaaaatgagttctaatacatctaaataaggggagctagtttttatgctatgtcattaccccagtttgttatattattagccaacttcagtaaatttagatttatttctagtctctaataactagcaagtgtatcaaacaggttctaagaatggcctatcgatcagcattcagcacgcgtttcccacaagagcaatcaggaagcgaacgcgccaacgacagctcggcaagagagagacgagagtcctcgctgtcgctggacacatggctgtccagtcaagtaaagaagcggagccctctaatgaaaggccgggtgtactgtagctaggtctgcaggttgtttcggctcgtgctggctggaatggatgcatgctgcggtaactctgcctctttcttctcctctcgctcggaagttgcgtgtgccataccgctatcatggccctaccacacctttagaaaaatagcacacatgcagcagcagagcatggctacaatgtcgtccgaagccgctgttatatatcccatcgaggatatggcctggcaaatccactcccagatgcatactacgctttccagcagatagctagctagatactcggggcgtgcatgcagagagcggaatatatatagctcaaatgctggtatgttatctctcccagctctttctgtatatacatacatacatatatacacatgttaccatatgtgtgcatgcttcttgtagtatactctcaccgtcctcccacaaaaaaaaatacagctcttacatctcaaagaatcaagcacacacagtttaatattcgactagaattatatagtgaaatgtcaacatttaggacataaaatataaatattactaaactacttatagacctaagttagtttgtccatcagaaatctcatatgttgttgcatttttttggggcgcgcggtgggagaatgatgttgttacatcgtcatatcgagcctttattgtgtgcttgtatatttgaagagaacatataacaagtcactgttctgctacgactaataatcatctagtattgtttccagctggtttgctagtgtgtcttgccataatataaatatatttgagtgtttttaggatggtttattttcgaggcgacctcattgcataggcaatagacattgccaaatatatgatgtagggtgttatctcgcatcgagatcccaaagctatctaaattcatgagtttaccttgaattcttagtctcatgacctgtcccatagtttcattatcaaacaatactcgatagttggcacgccaagtatatagttgaaacggcagatagacacaatcacactaatcatagagatctgatgtcatacatcggtttcgcacaaggagaggaggaagttttctttagtaccttcgtcggttcacataaaaatctggggattgtcctagatgttcaggaaacatcgacgtcccccatccaagcttcagaagatccaatctacacttcgacttgttttaactgttagctaactaaaaattaggtaaaattagttctaatacatctaaataaggggagctagtttttatgctatgtcattaccccagtttgttatattattaaccaacttcagtaaatttagatttatttctagtcactcataactagcaagtgtat

SEQ ID NO: 5245 - DNA, 1560 bp, Zea mays
  misc_feature (1)..(100): optimal_loci_3649_G1, chr1:18894018..18895577, Cluster 32
ctagaattaaaaatgtctcactcttagtgaggggtaaaactggccatcgatactaaactagttacacaaaacttgtactatttctcatggcaataaatgctaatgaagcttcaacatgtactcttcttggacgtttgactcgtgagtcctagtattgattttagagtaactaggactcaaacgaccgaaaagagtgcaagctcaacagtgagtgcaagctcaacagttgtgcgtataaaatagaacgagtgcacaatcgtcttactacctttttcatattttttgagttttaagcttcaaccataggaccagttttactagttcttagctcagcggaatcatgaggtacaatcacatttaaaaaattaggaagggccgtgcgtccaaatatgtgagagatctggctccaataccctacatacctactttagcttgctagtgcataggaaagttacaaactctaactaggaatataaacaaaatctaaacaaacaaatttctcatgcgtgagttcctaaatgttcttgaataaagtacggcttgtgctaagatctcgagacatggattggatggcatcatatggctggcttcaatcaagtatctaactgaattgtgatcaaacacactccattgccagacatgtcagcgctcctaccatcaaagcgtctttcaacagacctacgttaccatggttaggattatactccagtagcatccctgattatgaaaccatagctcacatagattgtgcgttcagatatacaccatctatagtaggactaaaccaaccttttgctcaggcggtcttgaacattgtgtcccgatgattacaagacagttatgttgcagagctttctttcgcctctcttcagccatcataatcaccagttgtataatctcctagctcggttgcatgcatcaactctcccgtgttaacttgtgtaatctcctagatccatttcaagtatcccaccactttcaaagaaagaagaacagatttgagacacaaatttcatatgcagagtcatggtagcctgcacaaaaggtcttggatgagctctcatcttcaacggacttatgtgtgatttcctccatctgtagatatctccaacaatggtgaacatatttacatttcaacaaacaaggaccaacatcttcatcgaactggttgcataagggacatcttgtgcctaaatcaatcttgcagcttttgatcttcatctatagaggaagactatatcgtgtgtcactctccatatgaagagtcttaattttggcgcacatgagagccttagtatcctctctccattccatcttctagttctagcacatggtacgcagatctcacaatgaaaactccattttgtgttgaaatggtaggcagtcgcatcttcctgtcctagctagccgaattggaattgccaaaatcttcaccgcgtcctcctccgagaaaatgtctataattggttttacatcctaacttccaaagtgctggattaattaactcagtcacttttgacactccgcccggcacctcttggtgttcgagacttcggaagg

SEQ ID NO: 5246 - DNA, 1550 bp, Zea mays
  misc_feature (1)..(100): optimal_loci_38651_G1, chr1:231189524..231191073, Cluster 32
tagaatagaaaacatatcacgtgaaattgtatgacatgcaactatatctattagtaaaattgtataacaaaagtataaggatagaggtaagagtatcttttaagaaaaatgaggggaatgtgggagggctgttttgtttgatacataatgtttttaaaatatcttcccacttcaatacttgtgctttagttgtattattgtaagaaaggatacgattgtacctgatttccctactggcttctgacaggtgggaaccaaataactggagtggctaaggcaaaacaccgagacaaacacaaaacaattactctcaatatgtcttatcaaatgtgtcatcttctcatctaggtgggggtatttatacggtaaccaagaggcaggatcctaaagtacgtgtctacccttggttaccttcgcattctcgcaatataatgtacaacaacataaatagagaatggtccaaattttaactgtgttccttactataccctcatctaggataacaatgtactcagggccgacatgtgcgcttgtcacgtttgatggaaggccccccatgtccatgctacccaaacttggctcttcggccccacatgctaaaggtcttcgcttcaggctctccattagtgtcccccagctcgcccttcggccttgcgccataggcgaggcgaggacttcgcttgtgatggggccttcatgtggaccttcacggtcgacactaaagacaacgatcgtcgtagacatctgagccctttgaagggctcggttcttgataggtgaagtccctattgttgttctaaccttcgacgagtcttccacttccaacagggtacgtcggggttggctcccaagctcatcttgatctttgatcagaggggacaactatgcagtcatcatccgatgctggagggggcgaccctagtgaagcccctgtcaggtcatgtcggggtcctcagactctgtgttcgcaaacatgaattagtgtgtggttagttgtagctgatttggagaatgattgaggtatgtttgttcttctccctaatagtagcccccgagggtgatgttcaacctgatggaccaatcttgaagtctaagggaaatgatatgaacactgccctcgatcatcgattgagcttcttcgggggcggttacattttgactgttagtttttattgattttactttatctttatttctatcatgtgggtgtgacctatataaggcatttcctgataggattttgttttttactctcttccttctagacgacctgctcaagattatattgtccttttcttgttcataagtcatacagaagttgccgaacgcttcagatcttccttggattcaacaatattagccgagagatcgaacaacacttccaaatgttagaccataggcacatggacaagtaattcaccatgatcgaggtatccacttcaaccgctatggtggaaagttgataaactccgggccagttcgatgggtaggagcgacccctcttatgactcaaccggagagtcttgaaattcttgggctagctgacatgg

SEQ ID NO: 5247 - DNA, 1619 bp, Zea mays
  misc_feature (1)..(100): optimal_loci_39923_G1, chr1:237839767..237841385, Cluster 32
tccataggtcgtaaaagccctaccaatacattgatgagcccaaccactcgacttcactgtccataagccctctaaggccacaagttaagcacctagaagcaagaagagccatgagctctcctctttttaaatgcatatacacccaatttaccaaatgtcatatgcacaagcataatggcaactagtctaccatgaaccaagccttgagtccaccatgagctagaaccctatccaccatagaccggcctccatgaactaataagcctagtggcggcccaaaccattaaatggtagcatagaaagccaatatgtgtctgagccaaccaggtagataggcacatgacccatcctactaagcccatttagtcctagtccatgttgatcattgaccattgccatgaccccacctatcaatgaccattgaccactagatccactttattagtgatttttgaaccattagccaattagaatacaccacatgttaccctatttttttatctaatttctctttttttagaaaatgaattaaacttagaaattttatactaccataagaaaatataaaacaagtgttcacttttttaaaaaagtgagctatgtgtcataggattgtgtttgagttcatttagatcttttgaatttcccttggacctttgtgaatgtctataagagtagcttatcatgattatatgtctcattttacgactagaggagtcccagactaacaaggactatggctacatcaaggaactctgagataacctaatcacaggtaccacatcccacctagctttgtagaattgcattaggcatgcaatagattgcttggcctttactttctacaatgttcttatgataggctgcatggtataaatcatttgattttgtaccatgtcatattctagctcctacatacccattgttaggaatagatgctcgccttacaaacacttgatatttacttctaataatatgcacgatatattgggatgtgatgcatagggtgtgtattaggcacatggtgacactactataagatttataccatatggataagaaaatctagtgtgcgtgtcttgggtttgtggtgagggtcgagtcaattagaaagggcaacataatgagtctttgaaagggtcttgctaggagagtgtgacctgagcctccctaggactgtatctatggtgattttatgtgagttgagtagttcctaagggtgagacacttcatgagacgagtccctaagaaggaggtgccatatagggcatgagaggtagagcttcccacttgaggacatgtcttgtcttaacctttaaaggatggagctaggagaaactattcataggaaccatttgtacatgccactaactttgaaagggcaggacaaatgtgatctagctagagtaataccactactacataggatgtaggttatattgtacaaaggtaatggcatatcctaccctcttgagaccacttatgaccacttagagtcatgttactatgatttagtcttcgtttgtctatggtactctagggtgactcagggttgagttgtggggtggtatcataccagttaggttacaacctcatatgaacctagatgggttattgtc

SEQ ID NO: 5248 - DNA, 1455 bp, Zea mays
  misc_feature (1)..(100): optimal_loci_40073_G1, chr1:238746014..238747468, Cluster 32
tgacaaacccaacctagctaggatgggaacttgggttggttgagttttcaaacgatactagatattagagaaaggtaccctagtaactcggcctagccaggtttgagtagaggataggaaaggatgtgttttctaccactttcttccttctcacgcacttctaggttttcttgagcatcactacttgtcttaaactttagtgaatcgttcctcttgatagtatgacaacactcaactcaaaataaatatagaaaatatttgaacctccaattgggaaggttgtcctatctacaagaggattctagaaggataaatatcgcaaatatcttatcaggttagaagatgggatcatgaaccaagcaaataagaaagaaacacatgtaaagatatatatcgattccctaataggcttggatgcaacccatatcttgtaattgacccagatacatatcctataaacatcgcccctccttggacaataaaaggagagcaataagctccaagagggtagatcactagatcgcattgcatagcaattgacaccaccacaaatagaacatagggtattatctcactccaagagctcaaacctatacaaatcttcattactcctgtgcatttacctttagttcttgattacatgaccaatcccataaattcactatcgaaaaatctttgatagttggaacgccagagagttgatggcaaccatgggttttgcatcaggagaagaagtcgtcttcaacactctcagattcatcattgatttgtttgggaattttgggcttatcctagacactagtggttctagtgtccctcaatcaagtttctgaagatccaatctacactacagcgaattttggtcgatccaatcttatggcatcgactcagacttgaattcaaccttgacactgacttagacttataatcaggtctggtttggaatctgactctaactaaaatttagacccatatgatcttgaagaccgtttcgtattcatggaaaactctagacaccaagatggtcacctcccaaaccatgcaaatgacaatgttgatgcattaactaggatccagaggaactaataagacctaggagcacatctagtttttccatgactatattcagatggttgattttcatgcataagtctatgcaacaccaacccaaaatatcatgacagtgaagctccttcttggtaaactcacaccactgcttcctaacgacaacatgtaggcttacaaagacctagaaagatcaataacatgatgacgtatgacgtacatggttgtgttctaaggcccctacaattccaatgccgattcatgacgttgttgagtcctcagatgatctaactttaaatgtgcaagagtaacccaaggagcgttagagtagtcagtagactgagtcctagatctctccatttgtgatcatcacaaagggactcggctacc

SEQ ID NO: 5249 - DNA, 2003 bp, Zea mays
  misc_feature (1)..(100): optimal_loci_40607_G1, chr1:241367645..241369647, Cluster 32
ggtttagacaggatatccatatcctcattattaagcttggtcgattatcccaaaagttgtcactcaacttcatgtgacagttgcattcggcccaaacagacttttgtaaaaacccacaatatgggacatcagctccttctgctattgccaccctaagtttttcctcggctttgaaggcatctatttgatcatattggtcaagcacaatacctaaatttttcatgacaagagctaggttttcatttttttcttgattcagaacagtaaacgggttcgtgattgtggtaccttgtggagcgtccttctcttgagctcttttagtagctttctccagaatagaaatgccatctctaggaattctagaacttgccctcatcacggggtatttccttttgctttttttcttcttcagtttcttacttgcagcaatgttccacctttgctccacatctcccatcgaaaaatcactatcccaatcagttagactctccagaccatcttcatccactcccttatcaaaactgacctctgtaacctcactttgctgccccaaggagcctcgattcttatctgttcctgcagcgatcttcagccctcccttgtttttaagttgtttacttaacatcaacccatcttttatgccctgttggttcccctcccggaccattctggattccattcccacattgtgatcagggggctcaccctctaaagtttttttaatcttttcaaaaatcatagagccatcatctggaattttacacacttcctccaggtcgaccacttcagacagttgactgtccagcaaaatctgcacattagcgaacttatcctgtgagataatttattcattcaccccatccacgcgaacctgatcctgccgaggctcttcgaccactttctgaagcattgaaatcttgtgatcaatagaaaatagtcctacctttgggtgaaatctagcaatagggagatttggtatagaaccttccaagtccaaacccaaactctcgatgttttccatgtcctcttgagactcaccatgacttgagtcatgtttcatttcagcctccttccctttcctgtcaaatcttcctcctcccttcctttcttcctttcttctagaatttcctctgtcccttgaagagtccttatcatcagagtttccagcagctgatgagcctgctaaaactgacccttgctgttggggcccttcagcagtgaacttcagctcataccctacattgttaaagaagacctccacaaagcctttaacactagaagggttacgacattctactttgactctcactgggccatctttaatcaaactcacctcatcaacagacaacagcaatgggtttaccaaccaaactagcaacttctttgactatgctttaatccctagctctattcggatgatcggaaattttcacccagacattttccaacatagccgatgactttggattcacgttagtttttgatatcttcactctgaatctatagatgggcatttataagctactcagtttggcaaaagtttccaaggagatcttgtcaggaaatgtggcaatgaagtcaaaattgtccatctttctaacctcgaagtcccatttgtcttggaccaaattctgaagccctccctcaccacctgagcgtaagatcttttcaacagaggggagatctctgcactggagacgatcctgacaaggtgccatagccgccgtatttcgtcaggcgtagcaggtattttctttccaccatctgttctgcacttggacacccacatccatgtggtgctagcaggcctccaggaatgaccaaaaacttgggctgaggaaaagccttttttttcccagcccaacatccccttggtcatcatcatcttcctccctagaagcatccgccattagtggcccctccgccccacctgccagaaggccatcagaagtttgtgagaactggagtccttcagtgaacacaccgaaaacaaatcgctcacc

SEQ ID NO: 5250 - DNA, 2713 bp, Zea mays
  misc_feature (1)..(100): optimal_loci_41309_G1, chr1:244765430..244768142, Cluster 32
gccaatgtcatagggaggaagagagacgccatgatagggagagttcgtccttcatatgagagagaaatgtggggaacacagaggatagagagaaggtggtatgaccaaggatctacatgcttcacacacatacattttcaatgtgacacgcaagcgcttgcacatgtttcaccccctattagccacctaaagagaacacagacattgaggggagatacatacacatgcttctttgagcacatcttttcattgtaaactcttttcatgaactagattttgatgactgattgtattccaaacaagtgatcatatattattaaaatgtttttataaaacaacggtgaaaatgctattaaagaaatactatttatgtagtagtgtttgtagaagttagaagaaaataagcattggtgtacatatctttgcaagaggtatgaggcagaagttagaaaatgatgggcttgcaagagaaccacacatgtcgaacttctttatcgagtgcttcttatggaagtaaatgttatcctttgttgttatgtatatatgtcttgccttataaaacacgtgagcatttaaccatcttaatttatgcttggccttgtcgtggggatgtgtcaacaagatacacatcacgacattctcatgggcctagtttgtgagggtgcatgaagcccacttttatcattggacacttaccacaacatgagaccaacaaaattatgatatacttaacaaggctcccatcatgggataagaaaccataaaatattatggccactttgtatatatttagtgatctcgattaatttactatgttgaccaaacatagacttatgcacaaaacctaactattaacccagccgctagatagttaagtagaaaacatttgcgaaatagggagaaataatattagtaaatgaaattagatttaaaatgacgcggaactggatttggtggagtatgaattgttgtactcaaaattaggacggaaggaggggtggaataggaataatctcatgaattttagattactaatgcttcctatatataaaaaaatggaaaagagatcatgtctataaacttatggtcaaaggtgatatcaatcaagaatttgaaatagttgcattaatagatctaatttacattttgttgaatttcaatctatcacttattactttagatgagctcctgccatcgattctgaaagaaaattttattttcgtccatataaagtgtgtggaatcaaattttgaccaataagctagaatcattgaagcctactttgatgcatcgttcgatggcgattcagaaaactttgctccatgtacatgtctgcttgtagtatcaagatgaactatttgttttttctcttgccattttaaatgttaatacttttatttcactttacatcacatgttcttggcattaacaatttaatggaaggtgttaacatatcaacctacttcagatgtagcttgcctataccattctttgagaagatacccataatatccattgataatttagcagtttatttacttaatagggctatgttttctttattctaatgggttctaccttctagacaacaaagaagatcctccaaatacaatgagggaatgacaatacataattttaaaaatggaacatttttgtgttttattaatgacatatttttgattactttgaaagcacattattaattgtgcaacataatcataacacactccttgttgctcttgcttttatcaagttcaaggaagcattagtaaataatatgttacaccaaggcaccctaatgaggacaatattcgctcataagtttgtggaaagaggtggggattatgttgatatagttcctccaatccactataagtatacaaattggggtatttcattcatcaagaataacccaaaaataagttattaaatactcttgatagcacatgagcacgatgtccattaatcgtcaacgcaataagaattcgagtgacaatgttgcttatgtggactcgagtataacctatttacactaagttaactatttactgatttagtacttttaattctggtctacgccaagcctcgatacataatatgatatacttagacaactgtgtaagatgttgtacaagcatatgtacaattccagtagtagtgttatgtgtaagggaggctctaggacacacatattgagtatgttttactcctaggtgtgtgtgtgtgtgtggaagttgtagaaaaagagatctcttatattagacgacaccaacaaaccaatattgtatgtggtatgtgatgacacaagcattatatctacaaaatagggtgtttttctttccttgactagcaaaagaatgctaataataagccaccaaacaaatatattgctttgttcataatgaaaataaaggataccataaatttgccaacattgtattccttctagtaagcaatattgttcataattaaccttgaatgtaaatttggaaattcctttcaacatttagagtgtagctactcctttgtctatatctcaaattttaggttgcatgtaaccagatgaaatgtatacataaggactatgtgacaatactagatcattgatggtgcatgtatatatactactatgacaacactataacaataaactaaaacaatatagtctccattattttttcacatagtaagattaatttggagtatcacaaaa

SEQ ID NO: 5251 - DNA, 1740 bp, Zea mays
  misc_feature (1)..(100): optimal_loci_42557_G1, chr1:251152150..251153889, Cluster 32
gaaattatggaaagataaaaagcaaagtacttgatattttgtacaaagacaagatcaattataaatatataataccgagtgtgtcgtgatcaaatcatacggagtaaataatgattgcaacaataatcgtcatgcggatttgacactataatgcatgttcacattatcagaccaagtaggaagttcacactgtgatgcatgttcgcacaatctgatcaaccgctagaacacaatcgaacatgttcaagctctccgttgtggatagtaatttcagtttttcaggttcattaagaaatttcagaaatagcatcagggctgttacattggtaacagttttacagctacagttcagataggcacatatctgaacgaaaaccaggtagctaacagagagtcacatatctgaataaaatcgcaagtgattaagcatagacaaatattttgcgtagtcacatatcggagcagcaacgtatgtagagtttgttcttcagcccgttttcatatctatcattggcaacaactcttgcaatcatatgtccaaaacatccatttgtatctcggacatgaagttctccagaacattattttcatgatatttgaatctgctccatcatctacaaaatcaaaagataatttgttttcttagatggatataaaccttatcattttgttcatggctttctttcatgcgcatattttattttaggctttttcttcacatagtttagttgattctattatatagtataatctctttactttctcggttactttcactaaattggcacatcattttttttgggaaaatgagattttatctactagtacctagctaaaagtatgagttaattttgttggctttaaggttttcagatcttttagggtttgtttgggtcatcgatcttcatttgtggcttggatcatcgtggccttctagttctaggccaaagcaggatgtccttagagattgggtggtctagtgcaaaattcaaaacaaggcccatttttaagaaagccacttatttaaacaggtttctttgttaattatagcactgaaacaatcttacgaaagggagtatccgaagaccctttaactgctaataaactaaacatatgactttggaattgaggaagtatttttttacatgaaaactgtcattctagtagttttatttgcaaataatattcaattcaaactttctgcaaaatatcatttctaagtgccagtgtagctagtgcaatgttttttttgggtgtgttaatgtaaaacgcatgtagtacttttttaacaactttaatttgaaattctactttgacaccacattgatcggaatagtgaacaaaattttacatgctaagcgttcttacgtttttatcttaaaggaaacaatggagtaacctaaagttcatatacaagtgtacggaccgaatatggcctaagagtgaagtgatttgggctctggttatattctacgcatgtccaagaggctgtgtttctctccccaaccaacctttatgggcgattgtaggatcgattcactttaaaatagaaaatcagaatggagtaaatgattacaaaagctaaacataaaattaaagacttcatcttaagcacaaaatataattagctttgtcatattaaactagatgatattagtgaattaacccaactagaatcacatcaattgaagtctagaactcaagatatgaaaataacaagcatgttatgttagaatatga

SEQ ID NO: 5252 - DNA, 2071 bp, Zea mays
  misc_feature (1)..(100): optimal_loci_42746_G1, chr1:251990505..251992575, Cluster 32
gacctgcgagtagatgaagacagaggggatttggggagtagaggtggtatgctagagacagatgtgagatctaaccctaaatttactaatgtcatgaccttggtgatcttactattaagatgattcaaattgacatgggcacgtattttggattgatttagctagccttgattttgccgattccaactaccatagttgaaagagtctttttagcaaaaaaaaaaaccaagttgatgaataagatatgcaatgattggttaaatcatagaactgtttgttatattgtgcgagatatttttgcaagcataaaaggtaaagatatttaatactattttcaagaattaaaagtcatttgaaaaaagctaccttcgttaccaccgtctacaccaatgcaagtggtatgttgtgtactttttttctaaattattttttctctaattaataacatctttagttcacatttctaatatgcttgaaacgtttacctacgcgtgtatgattacattcacatcctagcgttgatcaagatatgagcgacatcggtggtggttgggatcatccgtagttaggtatttttttttattgtgccccattttatgaagtacgttgtttgactattaagaaagtttttttaaaaaaacactattaagaatgttgtttatataaggcgcatggttatcatttggttctaaaatttagtaatacatatgacttgatatgagttacatatgcacttagatagtggacctaggcataaaaaaaccatttgctcccaaaccgacccataacggattcagatatgcgcggttattagtttgcttccaaaagaaaattggttttcagctaaagattattgcagatatgtgagaggaacgatgttgaaggttattataccaaggatccaactcgaagatgacgctagctagaatgtggattctgcccttttttgtaaaaaaataaattgttcagaatttcatgaccaagtcctctggcatacttttttttaaaaaaaacggtagtacatgtgtgagaataagttaatggagcgtaggagcgaagtgcttagcacatggcgaaatgccgctgttatcttggttggccgagacggagcaatagtttgacgatcacgcacgctagctatgagtgggaaatcatggcaggcacccactggaatcgttggagctcatctctgcgacaaaaatgctccggcatatccggatgcggtgatcattggatcggagttggggaacatgcatgcatgcggacgaagcgacgcagcacagcagtggacttggcctggccggttggtggtggtcctcgcgggcgcgcggaggcgccggcaggcaggagcaggacgcgcgttgcccagctgatttcggcagaacctcgcggcgcgaatcacgggcgaagggaatttggcactagtttgactgacgagagcatggggccgatcgtataacgagtgggaaatcatgcgtggcaaagcacccactggaatcattggagcacagctcagctcagccgagcgacaagaatattccgacagattcgggtacggcgtgatcattggataaggagctggggaacatgcggagttggccagttgggttcgtgggtcgcctcaccacgcggtggcgcctccactccaagtgcggacgaactgagtccagccggcggcactcctgctggttggcgccggcagccgtgagcaggacacgcgttgcgataatcacggtccgaggcgggaagaagaagaagaagaagaaaaggcccgcgccgcgcctgccgcacaaattgcttgccattcgcgcccgtgcgcacgcgcgttgatcaaaccgctagcgctaggcgatgggctcctgcctccagctgtgcagatgagggtaggatgagttctaacctctgcagctgcagtgtaggagctccatgtacgtcaactcctgctagctactggtgccaaatggcatacagccttggttttcatttactgtattttttagaatagatcttgaagaaaacaatttttgatattttagccataattcagtgcccatataatataactgccatg

SEQ ID NO: 5253 - DNA, 1528 bp, Zea mays
  misc_feature (1)..(100): optimal_loci_43223_G1, chr1:254526476..254528003, Cluster 32
attctcaccaagacaaggcatgaacgtagattttgatactatatttaccatcattgagtggagttgcttttggcatcttgttaaagatctagggagtagacttatcactttagatttttttaagcactttacatgtttcccatgatgaagtatattctacatgttcaaccaagagtacagtcttacttggagtgaactaaatattgctcttggctttgatgaaaattgtttcttgatcttgaatatgccactcgttggtccaatagtcttgaaatttttttcatgcaatgaccaatcttaatgattgtgagtacccccgaacaaatgaaattcccaattccactttgtgtttcctccatcattggatgggcaaaaccttgtttcttcgtgatgatgtacggattgtaagaaatgattatttaagaccaccttatgctatggctcacaaaaatcttgtctctcataggaaagccatggttgcacaatggaaaggtgtttctaaaagaattggaccagtttaatttacttcaacaatttctagacttgatgatactttatgttcgctcaatagcgctacataatttatttccatgcctcaaaaccttgttacaatagaatactctatacaagatcatattctagcaagaaatatgcggctctatggtaatggtttatcatgagttcatgaccatacaacaaagccccctaccttgtgagagacttcatatgtatagggtccaccatcgtttgatttggaccaagagactagacataggagccttgcatatattagcacaaagcgacgagtgacatgtagcatggtacaaaccacacaacttgaataaagcgacacatcatgaggcattaattataacaataataaggaggagaatacatcaaatgctatgtacatttcatgttcaagtgggatgcctccgctaagaccaccacacaccttaagtgtgattttctttctcgtccataagagcgaaatattgtggcttgcggaaagacataaacaatctcaccaatcaattgagtgagatgcatgtggaataatgggccatatgaggcacagtggaaccaaccattagcttctcctagccatgcaagaagagaacacacgtcaatggaaggcattttgggcactaagaggcgcctacccaccaccactacaccatgaaatggcaagcttaaaggaggttcccttccccaccaaggtaggttctatttttcttgtgtttattttagattatttttatttgcactcaataaaatctgaataaaatgcaaaaaaaatctttgttttacatatgcttcatgtatgtttatctcttcccatcttggaaatgatgaataattgttctgctagtgcttctctagtgtctagtttacaagttagtatttttctattttagagttatttagctcacgtgaaacaatatgaacctaaaactatatgggatgcaagtgttgtaacttagtctaagtagttgtgagatttgatatagaaaagacaagaacagtt

SEQ ID NO: 5254 - DNA, 1872 bp, Zea mays
  misc_feature (1)..(100): optimal_loci_44062_G1, chr1:258643259..258645130, Cluster 32
atgccgtggggttggtgcgtgcgtgggtctgggaattgccgctgtgcagtgctgcgggactactactgtctactaccatttacctctctgtttgatatctgtacttgcgatcgcattcttaaagctgtggatactcctacattttagcgcccagtacaacgcgctggggtagcgtgcggagtactcggaggtaccgtacgtgatcgacgtagtaggccagccggagccaggagtgtataaatgatttcacgaaataaggatgtacgtgtacattacagaatgtatgtgtatatacatgaatacacagccggctccgccgactgcaaactgcgttatttagagcatgtctagcggtgccgtacgtacgcccgtggctttcgaaaaaaagaatggcacgctgctctgctggagtgctgggccacacgctagctagctagtaccctggacaacgtcgtccttccgagttccgaccggccggccaccgggaaccgctggttacgcgtggtggacagcagtcaaagtaccacgggtaaggggtcgttaatatatacgtgcatccacgttattttcttcttatattgtcgtattcactttaattcacatacgctaacatagattaaagtaaaattaagtttactttcattcacctcaacgtatatagattaataagaatttggctacatcaaaataaaggacatgtttggtttctatatagggcaccacaaccagccaaatcttactcgctcgaattaaagaactaaacttatgtataaaagttagtcacaatgtgacatcttagacaacgaactaaacaatcctaaagtctcctggctcgatgagaacatgcgtagcgtgttttcatttatctcttcattcattccctaaagaaggtagagcgctggaaatggctcggttatgtgagcgtagtagcctcaactctaaaactataattcctccgtaaaaatgtaaatccggctttacaaaataaaacatctaatatccaagggcggatccaaaattagtcagtcgtcacgccctagaccattctattgaatctagtattcttctgatttattttaatctatagatggaaaatataattagagacatatggatcatgtcccaggccacggaccaggtggcccggggcttatatatgtctattgatatcggactaaatatatatagaaaattatctaaacatattataagtaatacatgtcactaaattgattataattttttataattaacatatttgatgataccgatattgatgatactaaatgttataaacttttaggtcatattgttaatatatgtgttctacaactttttgacgcttgcattctcaatgggtgtttcatacttattaaatatggttacacatatcatcgtgcctggcacatgacattgcaataaagaggagagatatagagagaatttcataggagatggtagtgtttcaagggaataaaactctgattacacagttatctagtttaaacctgatgtgatattattgcaaacagtacgttgaaactcaacgatgagaatgaccttagagctagctgatccttaaccttctcacctatcctttgaaaaacaatgatggatgtctcaattataataatcttgcattgcattaagcatcaaaacccaactagagacctagatatgttcgtgaggccttctaccaagatcaagaaagaaaggggaaacaaagagagaaatgagaaaaagaaaaggtggtaggactggtatgttagtcggcttggcatcgagctctatgccaatcttagctccaaaaaaacatgacgatgagccagacaccaagttatcgatcatggatgacgccacattggctagagc

SEQ ID NO: 5255 - DNA, 1418 bp, Zea mays
  misc_feature (1)..(100): optimal_loci_46197_G1, chr1:270729510..270730927, Cluster 32
gaatgactatcatgtataaatattaattttcatacgagtaagtccttttgtttagcttcagcaagaggaaaaagaaatgaaagcaagcatgctaaatcgtaggcttggagacttaccaatgaaatacctggggatacatgtgtcttataatgtgttaggcatacgggccttttagggtatgtctgacaagataatgaaaagattggatccatagaaagggaagtggatgacttctggaggtaactgcatcctcacaaattcttgtccaagcaatcttccaaagtatatcgttaggaaggacttgggagattcctctaagacgaagtttgcaagggaaagatattttggaatgagaggaactgctggatctgttaagtaatgtccagttaaatgttttggaacaggaggtacttgaatgttcatccttgtatatgtgctaatctgcaaatgcaaaattcctctgaagattaaattattcttatggcatgttttccataataaactacaaatagttgccaccctaaaaataaatggggtgggagcactttatgttgtgtataagcctgaaaacggttaagcatatcctttccaagtgcgtttttgctcaatatgtttggtgttgtaccagggatgcttttgatttacagggctttccaacatctacctgagatattcttgtatgcctactcatctagcctctctaaaaactttgacctcattaatctcatgattgtcatcatcagcatttaaagaaacagacgtcgtatcatgaccattatagatgtacttgtaaaggtatttctttaaatggtgctaatgacaactatgagattaatgagatcctagatgagtaggcctacaagaggctttaaggagaatctatgggtttggtcttaatggtatcttaccctagtgcagcaactacaacttcaccttccaggtgtagcgttttgaatgcgcagggagtggaaaaggcgatgttaactgagtttttaaggcaaatttttaagatgcacaaggagtttggaatcctgcgtcgaaaaatgaacacctaaaacacacaagttggtcggatcatcttagtatatcctatcaaaggggagacattatctaagagtggtaataaaccacgtgtgaggtccacctcatatgagtatctaaggacagttgaaggaaccaaggtcatatcatctagacctaagtatgggccacccgatccggtcgacccacccgaaaaataccttacctagtcgggccgggccaatgtgttgggcgggctcgggcttggggcaaaaattaaacctgtgggccttacctggtcctcttctctttgatcccgactcggcagccgccacgcgactcacgccgccgcaagtgtagatccccccatgccccagccgtcaacatcctccaggagc

SEQ ID NO: 5256 - DNA, 2043 bp, Zea mays
  misc_feature (1)..(100): optimal_loci_46549_G1, chr1:272459620..272461662, Cluster 32
gtaggcggaattagctaggtggtcgtgtggtccacggaccaacctaaaatttggtttacggttatagtagataagctctttaaaataaaaaaaaagcatgtagaccacttgataatttgattttacatataagagagaccacccttgctctagatcctagctacaccactgcccaggatctcttgcctggcaatcatgccagacctccaaccaaacaggccatataactgcccctaactgctagctatgagaacatgtccttgcttgaatctgcacttcaaggtcaaatttagagattcagattttcaccattgagttgacccccttatcagcagtttttagtgtaacatattgtccactgcaccctttacagcgagacatgcggccttcctgggttctaagtggcatgtgttggactgccggtcttagattgggaggggggctcggtcccacgaacaataaacttcatcctagcacaacaccgtggtgaggtctcccaacggggccaagttttttagtacatcaatcagcaatatcacaattgctgcaccaacaaatctagacgcaacatgcaaactagaggtcagagaaatctaaccacatagacctaaattatgccaacaaattacctagagcatccaaatctagcttgggaggtctaacacatgctgatatgattatatttctagacaaataaaaaacaaccaatttgacatgactagctcctcagaagtatgtgcaaaaatgcatattacatatagcttgaaggaagcttatctactactcactgtaaaagatagatgaagcaatctcatatattgctgcaacatgtaggcacacacatgcagccatgcaggtacgaaggatctgatatggctaggtatggctgccgccataccttgacttcctagtagatctccccaatgacttgctggacacacaccctgtcctttgattggccatgaacatcgaagcaagctttgaacagagtctgcccagtagacagaagaaggaacgaacgaatagttttctagattgtggctatgagccttgcgtatggtatgggccatcactgtgtgctctgcctctattgtttggacacctgctcatacatattctgtttccatccggcagtctgcctatagtatcccagtccaagacaattcgtcgattcgagttctagggtgctactgattttgcagatgtagatgcctagggcttagcactgatgcggagacagactcggtgagccggcgaggtggttacgctaagacagcggtgctatgccacacactgatacaggggaacaggcgcacaaacaacggacgtgcactgatcaggtatgggagtaaggcccaatttgcagccgtagaagttttttttttcaattgttgtttacttatttatttaattttaatttgttgtttaaatttaatactaatttatgaagaacactgcaaataattaagtacagatggacatggactcaacagtgcataatctcttcattggcaaatagaaaatcattcaatcttgcatgtgtactgtgtagaaaacaattcaaatttcaatcttactcaactatgttgcctactttggcacttcattatatcttaatttaatcccttcctctgccattagacacatgtagaagtaatgatgttcatactttgacgtgttgttctctgtctcacattgctaccatttatgtctaagtacataaactatgtatttttccttttatggacacttaacgtgggacaagttggtcatctgccatgaaaattctagatttgatcacaatatgtgtttatgatcaaaatatgcctggcactatggaagagacaacataattgtagttgctagcttcaagagaagttagatgaagattatttcagcttccttcatcagaccactaaatagcatagcatgtttagtttgtatggtgcatttgaaccaacaactcttatgcctagtagttgagatttgagaatgaaactggaaatgtgctaacgcacatgttgaactaaatcgacatctctt

SEQ ID NO: 5257 - DNA, 1896 bp, Zea mays
  misc_feature (1)..(100): optimal_loci_47108_G1, chr1:275587472..275589367, Cluster 32
cccgagccatacggtctcaggagtctattcccgagacacccatgagtctttgcgctcttcttaacggagggaacccactttcctgcctggatctccaagcttttgcactgtctttgggtctgagttggccgttcggcctatgaaatcagttgtgaggtccacttagggccctcaatagcccatgcaccagatccgcgtcatgagtatccaggggatatatatcccccacacctacatggacacaaccaagtttttcgagttggtttataggctattagataattgaggtctaagtcaaatcgaactctctcttggactcaagaatatcgcttctatatactagaagacagtatcaagacttatcacatccactcttgtgacaaataacgagaaaaagaggaagacgtccaactaacaggcgcctaacaaagcctaattcttaccaccatgtcagaaggaagtattattcatgagcaagagcctgcctacttaggaacacatctacttcttccccacatagttgccttcattgatcaattgtcataccaagttagagtcatagtcttagataccttgaccaccaagaccaacaccccacaaacatgagcatctttgatcatggtcgtgaggtcttttgttttggaaagagacatcaaccctaatgataaagaattttgcgacatctccaatgaccaccaaagtgtagtcgaaaaacaaaagacaagggtgctaggcggacatgcaagaatagacaatgcactcaatgatgccttcacatccaaattggccatgacacaatcgaccggtgacagaccaaagatcaacgtcacgaagaggcaagacaacaactcaaccacaaccatctggatggatccatagtaggcaatctcgattttgatttataggaagttgggggacacataatttataatgcttctaaagctaatgtaatactcatagcagatatagtacatcaggacccgaatttggaccctcaatacaagtgcctcagtgttatggtagaatctatagttttgatgcttcaaagatcatgatagacttcatcctgtggaacaccacctgagcacatcagagtagacaactaaacctaggaagaccaaggaacatgaccaaaataaaatatgcttagtcaacactcaaggtggtcagcatcaaaataggggaagcctaggccaccctcagcccaattagcccagggtgacttgtgtaactcacttgcgctcgcggcctctattgagactaaactccatacatgaggaccacgatcacataaagtcttccaatgtagctaaacactaaatgacgggatataatggtttaccctgctttttctagcaagctaaactcaatctagtacccatggaaattcaagtccatcaacatggacatatatgatggaaagaaagacccaaattagtggatccgatgttactcgtccaccatcaatcttgtggaggagacgatgatatcaaggtagcctagttcctaatggtacacgaggctaatccattgacctaagttgaatatatcaaaatgaactctatatacacttagcccttgctcatcaaaaaaatgtggagaacttatgggacacatgggcttgttcagttaattatcatgatctctactgctgagaaagatggtgaaagcatacacgactattatagtcactttgtctacattttgtgcacattggtagatgtatccaatagagacattattgtctacttcagcaattgacatagataagtacctctaccaagatttcatcagaaattggccaagaactacacacaagttccaatacatggtcgataggtggacaatcacaaaagaaaaaataaattacaagtatggcatttgaaatcacctaga

SEQ ID NO: 5258 - DNA, 1544 bp, Zea mays
  misc_feature (1)..(100): optimal_loci_48242_G1, chr1:281711782..281713325, Cluster 32
actttacaaagtcaagcacttttcctgtctctattaatatcgttaatgcatgcaatctccttataacaactgtctacattaataaccattaacttaggtggtcgtctcaaggggcttgcccctgttaaatggttaatagaggagatagtgctacgtcaccttccttagatagtatattaatgaaggtggcccatcttaatatgtctgtctctgttaatcattttctagtttacagtttccaaacatttaattgaatttcaatttgattgctatttttgtgagttaaacatagacaatatatattgagtgcacaatatatgtatgcatagaacacacatgtacatatgttctatttgtgactcatcattattgtagcatgaatgatacatgttacatgttatatacatattacttgtagtattttatagtctgctactttctaataaaaatatttgatatcttgtataatcacctaactgtagcttctcataatttttgatcttgttatacttcttgtccaacatagtccactcttatggttgaagaactttccatttggatgcacacatttgcgcaagaggaattcacatatgtccgctatggttctcattatttgcatcttggtgactcattctattttcaccaatcttgtatattctttagctactagtactggtgttgaatttgtggactctttgaggtactcacaagcgtagtatccatataatggagttcatggtgattgttttgtgcactacatgatatataatacacaataaaacatatagacaacatgcacgatataataccacatatgaattttaatatgtatcaggaagtcatgcctgatggttaagtgttgccctaccttttcttattcttagttcacagatcgagggatttgggatcctccatgtgcatcttgtaagtattgtacaaaaccataggagtcaatggtaaatttagtgcatatgttaaatgtaaaagaataagaataatcacttacaagctcaatatgcttcaaagttgttgtacccttctcttggagtatctaaaaagttgaatgcaacgatatgtgcctattgaagatatattagacgtgtaatctagtggcccatggtgcctaggctgcaccattcaaacaacacaatttttaaatattgaaatatgaaaagagtgatcctagtacataaatgacttagatgcaatataatttttttaaactataagttagaaagaatgacttagatttgactctacaatagcagaaatgacttaattgtaaataacatatcttaaatactagaatgacttaggtacaacgtataatatcttaaaatattgttagtttcaaaatatcttagattcaatcctgtaatgcatgaataacttagatacaatataaaacaccttagaaaatgtaagtggaaaagaataacttagattcaaaactctgtaagttattcatctaagtattctctaagtattatacaatataaaacaccttagaaaatgaggagataaccaagtattctctaagtatt

SEQ ID NO: 5259 - DNA, 1872 bp, Zea mays
  misc_feature (1)..(100): optimal_loci_50590_G1, chr1:293947282..293949153, Cluster 32
cgcggtggtcagcggtttcacagtgctagcggctgccggctgctcctgaatgtggatgtattcattcgtacgacgtaccctcgctctctttcctgcttgctgtacgtgttggaaaatccattgccggattctgtgcctgcctgtccccaacaatgattgattaccattatacgtgttctgctgtaagaacaaaactggacgaccaagaactagctgctagctagtgtgctgtgcaaggaacagcacactagcagctatgtcatcagtatctgtcaaaaagaatcgatggcatcaaaactagcatatttgctgaaaatttgtatctgcacacacacacacacacaaaaacaaacaagtgtccgtttccggatccggacactctggattgtttccatccatgattcatgggtaggtgtcctagcttggatgaacaaacaagaacatgcataaagtattatccaacgacgcgcggtacggtcccgttccccaccaggacgcaatatgggccagatgcgtcaggaatctagatatataagccattctcgtcaccacacccgtcccgaataaagtatctataaacgctgatctcatggacgagcttaaccaacgctccataatacgtaagcgatccagtactaaatgtggtggtggtcagacttccattacctgccacgttgctgtttgatgagctccttcattgtgatacccaaaatgacaaaatgggtgcatatctacaactacaagtagtattctgtttgctgaatgcagtgtccggcccaacaaggtacatggagatgaaaacatgcttaattagttctgcacgcgcgtattaaaggaaaaaaaaaggtccaaccaaaaaaaatttaaaaatcaaagcgacgacgtacaagttggctcgacaaaaagttcaaaaaagggaagtaccaaatgcacttgattgtatcactgcttaattagttctgcacgcgcgagatgctttacgcagcatgaagagaatacggtggtggactcgtggtgtaaaaactcaaggacccatggataattaatgctctcccttaccacaatacccttcgtctacactagtttcacatattttgccaatggtagtttctacaatactctttctctattgtctagaactaactgacaattattcttcttcctgtttttacttcttttttttttggtctttacaacgttctagcgaaattgactatccgtttgattagtgggctgtatgctcttatcttagaccactgtatgcgttgacttcgtctaaacttatgtttgtttgattgtctacatgtggaaggtacggattgtatgagtggacataaaacaaattactttattgtcgtttagctgcatccactctatgcctaaaatgcgcgtatctggccggccacgcttgccacgtgcatagcttggacttttaggatgctatcgcatggaaggatttttttttgttctttcagcacgtgcgcagacagatggcttttcgtggaatttattttggttattcgatgcacgtacctattaaaaatgcgcattaattctgctgtgaaatgctcgcttaattctgctgtgaagatacttagtaaaactatgttatctgtcggtttgatacataataccaagctgagctgtatttgggccagaaccacagctgggcactgaaccgcaccagcacacaggcgaggtcctgcagaaacacagcagcatttactagtgacacatgcagattacagcatggagaagaacactgaggttacttacaggcagcagcaggggtgtgattatgactcaagcatgctcagaaatattaattactccaggagaaagattgcgaagctttacactgagacgtgtcat

SEQ ID NO: 5260 - DNA, 1535 bp, Zea mays
  misc_feature (1)..(100): optimal_loci_51589_G1, chr1:300037148..300038682, Cluster 32
tcggaattccgtgacgtgtcaatacgctgcggcacacaggttagttagagcatgacttacgatggctaattaacctcattgtttcgtgattcgaccagatatatggaaaacgataaatagcttgttacagtggcactgggtgagctgaagcagttaagtttgagcgagaaaggagcaggacaagcaagttccgagaaagctggccttttgagggaggaaggtccaaggatgcaggtgcaggttcatgcaccacctgtatttgaggatggctgaccggggatgccctgcactggccgcggtcactctcactctagatcacttggcttggcttgcagctcatgatgtacattggtttgcttcttgagcactgtcatgtacctatgcatacatacaatacaatgcaatttgttgctggaaggatttgtttgtttattattcggttgtctacgcattgcctggtagctagagtgcatgcatctgcatcaaccatggccggccatggtggactgctgcttctcactcactcactcaccacgtgaccattctattatccatcctattgtagtatttctgctctactagtcttctattttagtgtagagaaattggtagtagcttgctgcatccaagaaaaactactaacaagtgaagttaattgcatctggtcactgcacttggcatctatctaccgggtgaatagccatgaacgacgaccacgacggcggcggaatagaaaatacgtggaaaagtaggtggatcggggtagcaagcagattcattgcaccttaattaacaacttgccatcgccagcacgtgtctgaatctaacgcacttctatgttttcttggctggctagctgacggcttgaccaggtcatgcctgctctattttttttccttgggattttccgtacaaacattcatctctctccacatcatgcatgccacggtggatttcaaattggttccaatgcagaaagtctcctttatctgtattagcgtttcattgcacagctcttagcatcggttgccacatcagttttttatagacttttagttaatataaaacacatcatttttattaaaattaaaacacgtctgattacataattgagcaaatacagttaaagattgcatagttcataaatataattaataaactgctattactcttccacctcttctgttagcttctttctcctcaaatttaagttgctttgtcaatatttctaaggccagcttataggcccttttttgtgtcttggtccatatcggcggtggaacgatctagcaatttattaaattactcaaatactttagtttggacaatcctctcactatcatcgcatagcttccttaatattcctttctgcttagatgacgactcaatattatttattgttggccctttcctcttccgttaagctattggtctattacaaccaatagggcatggtgcgtccatacctttttatgtgatgtggagtcataatcgttgttcaagttaagacgagatcttttgctcctaccattgga

SEQ ID NO: 5261 - DNA, 2217 bp, Zea mays
  misc_feature (1)..(100): optimal_loci_5284_G1, chr1:27105842..27108058, Cluster 32
taagtgaactaaaaacacacagggaaaaaaaatgtgaagtaataaactatgtaattttttcgcaaaggaaaagaaagaaaaaacactacctatctgacaccactaaccgatcgtcctattagtgctggcatgatattaatccactagcagtttggagcaaccacggatgtaaatcattgcaatatgataaggaagttagtggtaactctccttgtcgatgtgattggcgatggaacaccttgctgatctaggataaatatatatataactgggattggacatcgaattattgagtggaatgatcatatatggtgctaatgatgttttgaccctagtcaggaaaaaaaataacaacaagagcagtacgaccgacgtgcatgcatggtgcgaagagcaatcaatcggaaggttgcatcacggtttgtgtaacactgcaaaatataattaccgtttggtgtgtctcttatttgcatgcaactttaaaaaaaacatgcaaacaataatattccacgcggcgccaaagcccaaaggtgtggtttgctaatgatgttttgaccctatctgcagtgcaaatattactccgagaggtttgagtgattggacagttatcagataagatatgcacgtacatgaattagcatcttatatataaatataaaaaaggtattgcatctgtgtccccggcatttaagagacatatcggagaccgagaggtttgagtgaatggacaattattagataagctataatatacggagtagtattagagatgatccttgaacgcattaccagattattattacggagtacctatctccagcgacctgtccagactcccttgttttagtttccgccatatattttttttcccacattatatttttaatttttatttaaaaatgaacaattacgacaagttaattaacacaattaatccgccggagtttacacggtttggatgcaaaagctggttttctctattttagtatacggaatctgtatatttggaacacggttttgcatctccattattgtgctgacaacattgtccatctatatatatagacgcgaccaatgtgtggtttgtagacaatatgttgccgtaatctgacacgtaccccttcctcaaagatccgatcaaaatgcatgcagctagcgcaaatgagtgttccactcgatcctaggctggctggctttctggcctagctttgatctaggtttgccgaatggacgcttaactgtttatatagcagctctctagaagcataaaagcaggggggaaagagtagcaatccggtccgtgtatccaacaaaagctccaaaatgcgagctgcgtcatgaccaacagttaagcagcttttagaaagaaaaaaaaactataaacatcggcttttggacgtgtggttgcaaggaaacgaacaaaagggcgttgacgccgggccacattttttacgtacatttgcgtggcgtctagagcctactagcccgccgatcatcggttgcttctaagttctaactaacaacaccgacctgacgtgctttcgatttgtggcaaacggtgcgtcgtcgtcgtctccagaaaactgaactgcatgtgagccgcgcgcgccacttgttgtatactagcagcgtttggagtttggacgtgtgccgagaaaacatatatgtgctacatagtgtaatgttatgagtggagtatttgagacgacgtacgacgtggtgcctgacgatgaatggccccggacactacagctgaaactgaaaggggagaacaacaacgccaagagaggaacaacgacgacacgcagctacgacgcacgcaaagcaaagcaaagccatgcatgtagccagttattagctcacaccgcccaccacgcacgcacgttgaatggtaatctattgcatgcattgcacgcatatatattagcccgtgtttaaggtttcgtactcggcgcgaggtacgtaagtacatgcataggagtgactccagactagtagtagccacgtaaatgacgatgtcgcccagcgagaccggtcgctactaccgttcacctctactaactccgtacgtttcactggcccgaggctaagaagccgagaacagaaaacgcgcacggcaggctgatgaatggtgatgatggattggtcgaaagctcaacgaacgtaactggaagcagaggtgggcatatgggggggggggggggggggggcacgtac

SEQ ID NO: 5262 - DNA, 1716 bp, Zea mays
  misc_feature (1)..(100): optimal_loci_53765_G1, chr2:10660080..10661795, Cluster 32
ccttttatcacccgctactttgagaggcgaacaaaataatgctgcttgcacacaaaaaaacattaaaatgaccgggagaagcccgtgatcgagcgggccttttcttttttttaaaaaaaaagcggtaccaaaggaagatgctgtctcaactgaatgctttttttttgtcttcccttctgcgaagttcttcttttctttttttcactaggttgttgtcttccggtgatagtttgatgtaggatctctagtttacctgtaagaaactgaaaggatgtttgtcatgaccacatcgaccgatcttttgtagagcctcccctcacgtggacgtacggtgtgcgatgcaaatattgatacttcatacttgtagggtgctaaaaatgctgacgtttattatggcctcatgggtttagaacaccgttgtcggcagtcactagtgacttgattataaaaagctggcaattaaagcaccgtctcagagtctatttagcatacactaattaaccaatgagacaaaaaaaaaacatatccaagtttgcttccggccggtgacgcgcgcaaccaaaaaaacactagctagttatatataaataaatatcgcaacttgactgctagtggctgtcaccagttgcccagctcataatgatgcagctgaggctgagcttacggaggccatcagacacctcagtggaggtggaccgggtcaacgttttggaacaacaccacaaatagaaagcaaggagagctctgtttctgttctggctggcggctggcttcttccacttttaggcagccctatatctagctgacaggctggccatgcatgtataggcttggaagccatcttaatttcctttgcttggaagccaaaaaaaacccacggctgcagtgcagatgcttgagttgtattgtatctaaaaagttgtgctttgggcgcacaggcaaaaggctgcgaaaccttatcactctcgttgggaaatcatatctcagttatgattataaaggccatctgctttgggtggcacggccaatgatttcccccggcccccatcatcgtgcaatgctgctagctttttctaaacaagataaatgaaacacggctgttcttttgtaacttggtgtgttatttctcgtttctatacattattcttagcttcttagacaagacatatatacactatataatataaacctagtgagggcaattaacggcaaaaagtttgctcactttctacagagaaaggtaaagtttgtatgtgtatatctctgtatatatagcttgctagagctctttggcgtggttttattaattagtgtgggttttaaaactaggttctacacttaaaacaccagaacggatatgaattgagtgcaacgtcatcagtcagcaacatctgctctagctatttggtctaaagagagacagacacagagacggatacagagaggtcccatgcatgcttgtgtgaaccggaccggacaaaggctacgctgcaacaactcgcgatcgccatgccgcagccatgcaactcgctcgcgacgatctttttttttttttttggtctgggaagtggcaacgcacacacacattggggtgcagcagcagcatgcagtgcagctctgtaaagtgtaaagtgagataagagtcgtctctatacggcaacacacacacaacctagtgaatggatgtacgcatggagtagaagctccccacatttt

SEQ ID NO: 5263 - DNA, 1469 bp, Zea mays
  misc_feature (1)..(100): optimal_loci_55415_G1, chr2:19356242..19357710, Cluster 32
cctaccgaacatttgggtcgggcctagcttttagtatctgggcacggcatggcgcaacgagagtggtgtattcttctcttcccctagtttggataaagatctagaggaatgcaatcgaggaaaggatgagagggtccttatcaacccaaagagcgtatcagtgagatgtgagagtgtggcatgttgtgttggatatgggatgggatgacaccttgcgaatattgatacattgattgtgaggtatgtataggaaatccaaagccaaataataggttctcttccctatcattgcatatcgctaaccatataacaaatcgtaatgaaaattgttgacaaaggtgaggaacctgactatgacaacaacaacggatgttaggaggattgtatggtctcattatatgctcaatatgtctaaggattgagggttatatagtcttcaacttgttgtcgtgctatgctctactccaatattgttgtatgtgtgtttccgctagtgcgacattgtactaaaatagaaaaaactatggattgtaatcccttttaaatatataatcatgttgtatatatcgtggtaccacatgaataatgatactgtgaaggcttggtcttccatgggactatcacattatattgtaatatgtggatttctcttcatggatattatgaatcgttctagtatcaacacgtgtggggataaaatactataacgatggtgttctaacacggcacacatagtaaaaggaaagacggagagagagtttgggtgcccgcagtcatatacattttgattttgttttgtttcagcagcctcacaaagacgccagaagagtgatgtacttgctctctatctactgtgttttggtgtactcactgacttcgtgtcacatgaatcctcctttcgcgtgtacagccacctacgaatgaaaaatatctgaacaacaatttaatagcctaataaaggccacatttcttggcgatgatttcaaatgttttcttttatttgtattgaaagcgctagattggctggagatccttgatttgatttacaggctggttggctggtttcaaatttcaatcaaacataggctcaaaatagtcgatgataaacgtggtgcctgctacgtgcttgcttgcttgcttgcatcgtgataggctgcgcagggccacgggacaaaggctaccggtaccggtacaagtaattttctttggtagctgtagacggccagtgcgacgaccggtccaaagcgagcatcggagcgagaagtttctcacgcccgcggacccggaggacgggtctcggcgagctcgtcacgaaagtctcgcgttcagtgactccgacaccggcaaaagttaaagccagacgacaatgctacatgctgtgcctgtgctgtttgctgcactgcactgcactgcagcccgcgccgtatgtttcttgtcactagtactagtggtcgagcatactttttata

SEQ ID NO: 5264 - DNA, 1483 bp, Zea mays
  misc_feature (1)..(100): optimal_loci_55524_G1, chr2:20099003..20100485, Cluster 32
agtggctgtggcgatggagtgagagacaaaccggggacgtgacagaagccaagagccagaaggacgaacgagaaacgccattgaaatgactcgatcgcgcgcgagcgccagttgaagggactccgacgcgtgctcaacggcggccaatggacgacagcggttagtacgtcaactaaccccaacgtattattagctacgtaaagagtggttaatactaacccatccgcatataacttccatacgagtggtcattttcttacaccaaccggagaacggatagcctctcaaaaataattggtggcgccccacatgtatctaaactatattacattacattcaatatataggtgcatggctcatattaaattaaatttagctatatatattgtttgtctaaacagtcgtttagtctgtttaagcaccatgcatataatcttaatactacatagtgctatatatattgtttgtctaaacggtcgtttagtccgtttagcccgtttaattaatcctgtaacctgattaatggttctagcctaaataatggttaaactgtaggtgtgtgtggctgtttatagtttagcgtttaggaaaaaaacattggttatacattaaatgtgtccagctcttgtcgtggtcattggggcgaggctccttaatggttgtccagatgttccagaggctccaatggtttttttggcacgccatccctgaacgaaatactcgtgactcgtaccgactgtaatccactactttgaacaacacaagatattggctcatgtaaatgaagacactagtttcttgaggttgggtctctctgctagacataattcactatctagctttattaaatttaatataattttagttatagtgtttacatatatcattataaatttgctagattatttttttttaaaaaaataaacatgaaaatggctaaacaaatgggcgagcgaaaatatacatgggtaacaccgtgagttgagggacggatgcgtacgtgattattgtcacatggcgcgcgcgttggagagcagtactacgtacatctgtatattgtacagttactttgacgaatttttgggccctttgatcctaatagaaaaggactgttgaccaattatagatggtgggctccgtcatcgctcttcgaatcggggctttcccttggttttgcagtttgctttcgcgctgcgaatctggcgcgaatgaaaccggctgtgtgctttcaaccttcaatataagaggcaaaagcagcagttgattgattgggtcgatactcgttgctgtcctgacggcaacggcgacggtagggaaatcttcagagcaagagtggcttgttctcgtcttcattcattggattcagtctgtattagctgccaattccacgacagctgtgagtactctcgctcgctgccgcatgtgcaaaatccatgctttaagctgtgccaccctgcagcgtccatccatggattcctttggt

SEQ ID NO: 5265 - DNA, 1590 bp, Zea mays
  misc_feature (1)..(100): optimal_loci_58912_G1, chr2:39756860..39758449, Cluster 32
agtacaacttgtatatctaccataatgttttgtagtttcggcagtatctattttgtcaaataattattttcactgaaatcattaggggacatgtcctcttggaggccatgtcaagttcctgaataacttatattttataattggggtattttttcttaaggtatcttattttattaataatacgcaatgggggttggtaatattccttttcttatgagtgttagaaaaacagagaaatcggctcagtttttaaaggaccgattgtctctatgctctgtatttaatgttgaatgctgaactctagggttctgtatttaatgtccattgtctctatgctcaaaaataatttgacttcggacttggttttaatgactgggataaaagtatttactccctcatcgagatgtacacttggataatttacacattcagtttagagcacacgattcataggctaatacctgtgtaactatgcagagacacaacagaagatttgatgcttgtcatgggatctctttacgcggcatgcctgtttcttggtgtaaataacgcctcatccgtgcagcctgtagtatcaactgagaggactgtctactaccgggaacgtgctgctaaaatgtactcatcgttcccatatgctgcagcacaggttagccaagctcacatctatttttttctctagagattccagtttctaatatttcttaaaaccaatagggtcttgtagagattccttacattgcagttcagacactgatatttggcctcatcacgtacttcatgatcaactacgagaggaacataggcaagtcacatgtcatcaaggaaaaccattcttcatcaaaggacttcatgctttctacacatgatgttgtttcttgtgtgttcgctgtattctgatagactaaacatttttgtcacaggaaagctgcttctgtatcttcttttcatgttccttactttcacctacttcacgttctacgggatggtggcggtaggcttgaccccaacacaacaagttgcagcagtagtgtcatctgctttttactccttgtggaatcttctctccgggttcctcatcccccagtctgtaagttactgaatagcccaaagaagcagagtatattacatcattatgcttccaattgttccaagttttgaacatacaaatcttgctgaacctattcttgtatttgtaaacatgatgatatatagtttacatgttaaagtagctttcaagtaaaaaaagaaacaatttttcatagttattgaacgtaaccagattttttatttcacacatcagttttgagtcaatccagagagcgtttcagtatgatgctgtttatctgtttctaaacgtcgtgcttgtcattcgtgatgcagaggatccctggctggtggatctggttctattacatctgtccagtggcctggaccctgcgaggcatcattacatctcagctgggcgatgtgcaggccaggatagtcggccctggtttcgatgggaccgtgcaggagttccttgaggaaagcctggggttccaacaggggatggctggtgtcacggttgcggtgctcattggcttctcc

SEQ ID NO: 5266 - DNA, 2310 bp, Zea mays
  misc_feature (1)..(100): optimal_loci_59034_G1, chr2:40489516..40491825, Cluster 32
aaattggtgcaaagtagatgcctagatggcgcgcggtcggacactactctagatgtgcaattacgtggctaaagtagtagcgacgaaatcaaattccacagtcgttcacgtcaattaattcattttcttgtttgggcttgcattttttttttcttttctgcctcaaaagtgactgacaaaagcgacaagatgtacatgctgctgccagagttacaaaaatagtaataaaagaaagctataatgatctttcgcttttgttgtcttgaggctcatgccaagcctcttaattatatcccattttctatctcattcttcatttcaagatctacaaacagtgtcttccacgtctatctccacgtgagagatggcctcagtggaagatgggcaaaccggtgttccctcgtcctcaaacgttccaagctaggagcttgtactagttaacatttttaaatttagctaaatttacaaacaaaaaatactataaatatttgtatgtttaaacaaaataggtacagaaatatatttaaagaactacctaataatactaattgtacatcataaatattaacattttctaatatatatatatataaggttaaaaatatttaacttgttaaaatgtggtaatgacacagtgcaggtggtcaaactcatttatttttttatcaaatttacataaattatataaaacgtacatcgacggttttatttcttaatagttattactataactttatatttttttagactggtcaacaaagttggaaaagtttgactgaaacttaaacgaccaaccttttggaacaaaggggtgctatttaaatcaagcaggaaaacaactacagtgatgttctccaagcaaaccctttttaattagtaataaaaaggtttggcgtgatcaataatgcttaattacatgatgatggctttctaaaaacattaccactgcagggcgaaccgtaatattccagtgatgttctccaagcaaattcactagggaacaattgcaaatcaccactaacaaatattccatatgtttctcgctttagtaatttgcgttacatatcaaactttgctaactttttataagaaaatatagtaacatccagaagctcaaataagtgcacatggagattttagtttaattatttttgatactgtgaatattgcaaaattggagaagtttgacttaggaagaagcaaggtgacatataaatttggaatggacgagggacatcatctcgtatctgatagaaattgaaatccactggattgcttaagacactaatatgccaatcggctagccttaatgatgatagtggtcgcgttgatcattattgtcgtgcccatcaccggtggtacatagatcaagacctctaggattgtggcggctagggttttcgagcgcacggatgcacatctatgttggctcttgtctctatttatgttgtgtctatcgtgacagggtgtcacaactaagggttggtttgtgtccctgattaggacgtgtgaagaccatacacacacgatgaagatttggtgcttatcccaactcggtttatgttaccaagtcagagaacaccctaatagcatcctcacggcccaagattatcttagctcggcctccttttatctataggaagaaatgtgcaccatttgtaccagtgccaataatcatgcatccttaagccctaagcagtgagtcctaaagatgagatatgctgcaatccgttcttcaaaactctatgtatccgtgtgtaatgtgtatacacacaacaactggcagatgtgctgttgcaatcacaaaagggcagaggccgttgtattgtctctgtccagccctctgcaccttagcccctgcggtgaacgcctctcgctcttgatcccgacgacgaggcttgtaacgcaatctggatttgcatctcccagctggttgctcatcggttgttttgcttggagccgtgtgcgatccagctaatcaacctggaagggttattaatgtcagcatgactgcatgatgacacgacacacgaaatagcgggacgtcttatgtaaacacgaaatagcttggagccggcctccagacttggccgtgtgcatgatgactgcataatgtcacaaacacaaagaagtggccgaaattaagtaatttataatttataaggcattatagaagaagttataaagatttataacatcaaacggacatactacataaatgttattattttattatataactttatttaaactagattacggttttcagatgacttcttatgaagtttcattatcgcatatgattggcta

SEQ ID NO: 5267 - DNA, 1795 bp, Zea mays
  misc_feature (1)..(100): optimal_loci_59249_G1, chr2:41754758..41756552, Cluster 32
acaacttttaattctaggttttcttattctgggtaaggcactagggtcgatattatcttagttgacctattcgtttccttagcgctgagtaggacagggtggagtttgactaggttctaagttctatgggttaagacttttcttcactcgccgatatatatgttcaaaggccttacactacatttatcaagtccccctaactagattttactgtggaatacttaaaatattgggtaacttattagtttgactatattccagtggtttctattgggatctatttatacaatgcatacttaggtctcctagattgaactcatgacaatttggattaggaatggggacatgagtgttgtggttggctatattattgcctttgactatgatagtctaggtcactatgccaatgaagaatcatccgttcattggtaagattgtttggcattctagtcggtgaaatgcaagattcatatcaagacttaaaagaaaagttggcaaggatggagaggacttataatttttaattcaacttggttaactagattttagagtataatacttagtgaattgcttaccttaagggttcaactacctcatgttggtcagacaagatgtatatgattaaaaactgatggcagtctagttagggtgatcagtatgactcatatagtaggttgctcgatacttcagttgacaagcagagaggataacacctattcttcaatgtttaatctcgttaagaggacaaaagcttataatatctatttataaggcatggtagtcgacaaggctggttgcaatgtacttgatctttcagtggttgcagtagttctctagtgaacgtgcaagcacattagttccactaaggattcttggtgaagctagatctaaggtgtccgaaaaacgggcagggtatgaatagggttggtagcatatgtacacaacaaaatgacacataagcataagttgcttacctatgtcttggttatggtgaagctaaatagtaactccaagatccgatagtcctagaatggatccttcaacttgtgtagcttgcggtcatgtactattatagagagaatgaccctaagactctaacaaaggtcacaaccaccaccaagattatgcaagtttaagcgaccaaggattatgatggaacaagcaagattgtaaagggaaaagcataggacgacggagctatactagatggactcaagcactaacactaatggtggccaaccattcaagggtccactagggaaggtcttcactcatggaaaattctaatgtggtttggttggttgtgaaacacaatgctaggtgaaacaatggctatgagggcttgaactacgatagagaaattggcatgcgttctctctatgaatgatagcaagaagaatggaggaagaagacaagttctaggaggaaataatggtgtggtacaattacataactaaagcagtggggtgtcatacacgacgacaacacatgatatgaagcatttccttgtgcacatgggcacaacatggcaaagaggaaggatatgtgacaacatgtggcactaaagttccgagtatgtcgagcatctagttgggtgaacaactaacctagttaaatgaccaaatgattgaatcatttttattatggttccagacttcacaacttctctattcttctcatgatcaagaataaaattttatcgatatgtctaaacgaaagttttaaatttgaacaactccaactaaattaagttgggatacctttgtatgccatttgtacctaaagctctataaat

SEQ ID NO: 5268 - DNA, 1482 bp, Zea mays
  misc_feature (1)..(100): optimal_loci_59251_G1, chr2:41762770..41764251, Cluster 32
gtatggccttagagctatcatatgctaaataatgggagacgagggaacattctataaaatcttccttttctcgagactaaaagggggaaaagatcttcctcttattgcaaggctaataaaagtagaaatccagttgtccataaatgcaaaatccatagagaaagtaatcgacaactcgaatctccaacatgtggtttattcaattcatacttatttatgttatcttccttatcgcacccagtagaaggcacatgacaacaattataatttgaaagacttcccttcaacaacaacttgttggtcatgagtggttgagtggtggttcaaagtccgagcttatctccacctataaaactcacactatgtgtctctatttgattgatagggttactttaaatatatcggagatcaaacgataactaaatgcttatagtattaaccatgccatgatgacttatttaagttgtgaatatgttctgcttgcttgtgcctttctctcaagaaccaagagcgccacaaaggaaaatggaattcaaacataggaaaacaaaaggtatggtattcatagttgtgctttgtaactagagcctaataactatatcaattgatggcttatgttgaacaagatcttgcttttgccctatggtaggtggagaatgagtgacacatggtatccatgagactttactgtgctcaaaagctaatgactccttgaaaagccatttcgtgcttggatgaccacgctaccatgtgtaccaattatcacattgggaagtctgcatcataagcatgtccatcaatgtttcacattatgatatctttagaccattgtgcaaaatgttactgatttctagtgtttaggttcaagagttgtttagttgatgctaccacattgatcctatgtgctattatcagaatatggtcatcaacatcttcctatgtgtggatgcaattcctaaaccagccaaaccttgtctctatctacttcatcatcagatttggttagtatcggtggtccaactaaaataacccataggcactataatcactctatttaactattgagctagctacacacaattaggtgcatacttcattctacatctgactacaaaaaaggttaatttccaaataaatgcatatgattaggtaataaaagaagcgtactaggtctattatgctacatagccaatgatatcaagacaacaaatagaaacatcgttttctagcacagtagatcccatatttgcatcagatgctcttgattagccaagtggatctagaaaacatcgagagacataagagtgtcatttaattgatgcttgcctcgtaagcggtcccatatttgcattggatgttgttgattagccaagtggtcctagaactcatcgggagacatcaaagtgatcatttaattgatgcttgcctcgtaagcaatcactactatagaaaataatgctatctaggacataatatatgtta

SEQ ID NO: 5269 - DNA, 1585 bp, Zea mays
  misc_feature (1)..(100): optimal_loci_75336_G1, chr2:143253828..143255412, Cluster 32
ccaactagtgatgaggaactcacactattaggaactactaaacaaaacaagatataacaagtataacaaaagctcaaagctagtatataaaacaagtagagttgaaagactacttgaaaagatagcaatgtattgtgataacactagtcttacaaaaaggatataagaacattaccaaagattctaaagaccacttctgaactatgagtagagctcaacttactctcactcccactactagcctaactaaagaagtgattaatagtggatacttcttatcttttggacttggtactctacttgtctattttacaaatgagctaaacaccactatttatagtacataagagtgggtgtatttgtagttaaaatggaggcaattcagctaacaagggggtcaggtgataccctatggcatcaatgacccttgaatttcttcgataaagcgtctaaggtctttaatgactcatccatgttggtgtggcactatcctaagtcagttatatggaggttgtgggattctttcatcgacctgtggagtcattgatccttggatccctccatggaggcccttggatcaaaccaacaaggaatcaacaagtagatatattccattttttgtttcttcgccaaacacatggatcattgatgtggagctgacaggggacattgagcgacatggggttgaccgacctaaccagttagaccgtggggcttatgcctcctttttctagactcccggtgcttcatttcttcataatttatgaagttcttcctccattcaaatattttcaagtacaagtggaaccatattagtttaaaaaatcatgttatgttgatttatccctttctttgttgcattattgatggataagattggcatttagtattcatcaatagtagtcccatggaggtccatcatgttgagttctagcttcatcctaagttcttccttcgagcttctctagaaagaaccctattttgggagaaagtcttccacataccctataataatcatgtaccctagttaaggtttagtgatttggtggttgatcaacaagataaccaatgaaaccaacaatattttctactacataagttcttagttatagcgatgtaaacgatagacttatcctagtctaaggtatagtgattaagcgctcaacaccctaaaggaatattaaagatgagtattgaagatcatagaagacatgagataagctaaagacattacgaaacataaatctagacaaaagagcgaaggattcaacatagaagggcattgaaagaagcactagaggttttcgatggtcattggagttatctgttgtgaacaataaggaagcagtgcatgatgtatttttgtgtggttattggagtttagcaccaaagttataccatagagccaatgcataggtgattgagaagagcacaaagagcatcaaagccctccaacttgtgcacgaagtactgaggtgtgtctagagagggcctagtcctctagatagtacattataactctctattgtggcaccaaacaaaccacctaataaaagatccagtggttggcaacacctagttctta

SEQ ID NO: 5270 - DNA, 1449 bp, Zea mays
  misc_feature (1)..(100): optimal_loci_7580_G1, chr1:39781194..39782642, Cluster 32
gccatattaggacttgtaatattatgacgttagaaaagcagtgtaggtggtactgcatccttttaagaaagattttcaatatggctaagtttcaaggactcgacattcatgagctcgtatagggacttgagataataggacgtcagtagaactatgtagttgatactacattattaatgatctcttgaagataaagtgacaattatgtaggggtttatgtgaatcattgagctgcatgagcttggcttctagatgaccgagttaattgaactcaacatttgattcctgtagaagatatataacaaagggtcgagccttgaggactcagatattgtgtactcatatagagagttataatttttagacataaaagaagccatgtaggcaatataggcaccctcccaaaggatttgtcgtttagagtcttgtagacttggtgccctattgatgggctttaaagcaacaacatagtcgtataggtgatactgctaccttctctaatgggaacttaagactacctaactcgacatctaagaaaatgttttaatggaggtgacctaatcccctcaaaatcccttgggctagatagaagtaaggaatgaatcttttagcgaggtgtcagtttatgactcatgttgtgtagacaacaatagagccatataggtaatacttccaccctcctcgaggggaccttagagtctccctaggtcgacgtccaggtacatagagtcatggggctagcatctagtacatttataggactaattaaacaagttgagatctaatggtcaattcatctccaccaacctttcaagaaaatatcaaggaaaagatcaacgtaaactcattttttgaggtactcaatacgaacatgtaggtatatgatactagcccccaacattttggtcgtagtatgatggccaaaatgttcaagatatcgaagttcactcatagacgtcctttttgaaaaagagaataatatataacaatatagaaaatgttcaatggttccatacataaataatggtagaccccaacatctctgatgtgaacaacaaccgagatgttgagagaaacttcactttggggatctttacttatcaatccaaaatactctactaatgacatgtcaattcttcgatggcttattagtcatagcagttaaagataataagttctatatggcaacctattggtaattgtcggtagtattgtacttccatatggttcttcatggaatacattaaacaaattgcttataacagtgtcgtcgcagaaaatctattggggattgtctagcaattgacacatgaggagctgagaggtgagctattgttgtggtcgtccctcctaattgtgactctagatgtggggtgctaatatttgtgaattgctctacaaaggcataataacaaattaagcatcaaattctggtcaaatcacgtggat

SEQ ID NO: 5271 - DNA, 1437 bp, Zea mays
  misc_feature (1)..(100): optimal_loci_76728_G1, chr2:151680440..151681876, Cluster 32
tcgaatgtggactggaagcatgatatcacgagcctttagtgcgacttctaagatcttgccctcataggacataagatcaagatggaggctagaaaaattagggggtcgaatgggccaagattatggatcgataaggtcccaatacaaaatgggttaccaacgcaaacttccttttagccttgcaactgtaaaccccctacgtggggaaggacaaggcgcattatgccaccatgtctggtccacaagaccacatagagaccaaagaagaataattaatgcaccgaaggcaaaagaccagccatcggtagtactgcaaccagccctcaacctataatagaacaactaatccagcaattacatgttacaaagatatcatcaagaaagatataggttagtcgtaggggcaaccacatatcaaagggcaaccctcatgttagaacatgtgatcgaagttaggcatcaacttgcaatactctaagtagaaatccaaagtattaccttagctcaaccaagccaaacattagccacaatcacatagccaagacaacccatatagtaaaatttaaaaccctagcaagtcatcgtaattcaaccaaagccaatagacaacaagtcacccctatgcaaaagtctacaaaccctcatgttgtattagtgcttccacttttgccccatgatttgccaccaatgacccataaatatgtcttatgcaattgtatctcatgccgaaggttgcatgggcatgataaaaaagccatgtttgcatcttcttcacatgtgactcggtattttgcgttgcttctagtaggatgcacaagttttaaggaccaccataagcttgattctgctttcctccatatcatgcatctcatcaatacatagaccttggtgttctttatagaagtaaaaaaagataattacaaacttatagtttgggatgatcaacggatgtgacctaataagcgatgcccaaaactttgttgctaatcgagtcgctttgaggcaaccagcgagtcgtctagctacattagtaatgtgttcgttgcaatgctagatatccaagacaaaaggaaggaaatttggttgtggagcaaacaattctttaagaaaaaaagttggagattttgtaatcaaagtggagatgaaggtgagcaaagagttgtggtctaaagtaggtctcgatgggagagagagagagagctagatggtaaggccaaatttagattattgttcatgaatacttgattagactatgtaaaacaacaatcaagaagggggagctcgtcgacacccggatctagaattgtgtcactgaatgcagccacaaggaaggcagaggcattgccattgcttttattgtttaccaaacgaaccaagttaaaatccctaaccaacttctaggggctagagatctaaggaagatgccctatggggtcc

SEQ ID NO: 5272 - DNA, 1424 bp, Zea mays
  misc_feature (1)..(100): optimal_loci_81629_G1, chr2:179983714..179985137, Cluster 32
ctgactaattctagaaaacaaaccaaaacctcagatattgtatacttgtttctcacaataatcatatgcaagtataattttaaaaaataatcatatgcaagtagctgcacaatagaacatacgacactacttaaaaaaggcacagctgtaaagatgagtgcgcacatatgccttttgactaggaatctctctcactctctgaggcatatgcatgattttcacttggtatatttgcttttgcctttgttatgtttttggtataccagatgcaaatggaacgcattttctatagaaggagctagctagaggcgcagcagcatatagtgttctgttgcagctacttcatgcattctccagttattaattcatgtagggtaacaaagatcgatgatagatgcatgtagcatcatgcactttctatgaacttgcatttcggatgggatgtctacgactccttttgagagagctgcaggcaggtatacaatgacgaacttgtaccgtacgcaagaacaaaccgcgctagtatagcatggaatatatataatgacttgatgaatttaaatttatttaatttacagtataatacacgtacgactggtctcatcatcagtagatgcatcatgtgcatgcatgcatggacgcgtagcatgcatgagcggtgaatgtcgctacacagagcaatgcatgcatcatccatcctcggatccatccatcacatgagaatctgtcactagctagctagctagcagctaggtatagctatacctctgctagatacttctaatatactaatggttgtggcatcgagagggtcaccttattattcgttggtttacacgaatttggtggcgcgcgcgcatgcacgcggtatagcacaccggatttgatgcacgcacgtcacgcaacggccaacagtggtgacactcccagcacactagctaagctaggtggtgcgttgttgcatatatataatgtagctagcctctggtactacgacgtacgtacgtacgacgacaagccaagagattctgtatgcgagtacaagactactggtagctaggtgtgcgtgtgtgtgtgcagtgtactcagctatacaagatgtttatttttgatctgtttgcgccggccaaagttagtacgtactactgctgcagtgtatagcgcacgcatactgcgtatatccattgcgatctcgaccgggcaaattcaactgtcgtcgtcgtcgcactgttccaacatcatcaccacactgcgcgcccggccgctttcctccacgacggcggaggaaagcacagctagcagttttcttgattcgtggccaggcaggtggtatggactccgactacatcatcatcaccacagttgcagtgatttccgcatgcgtggtgacttgggccaaaaccctaaactctttgaatacttgg

SEQ ID NO: 5273 - DNA, 1611 bp, Zea mays
  misc_feature (1)..(100): optimal_loci_82184_G1, chr2:182875426..182877036, Cluster 32
tactcataataacaaaacctaaatacttccgagagacggccgccgatctagctaatcctcgatcggtgcagagaaaggtagcgtttggtttcgttagattctaatgagtatctgtatcaacatctctctatccgagaagtcctcattaatggaagataaccgaacgaggggcatcattacaaaaagacaaaagttactatctgactcgtgacttccttaggttaggtagcacaaaatccaacgtattagctgtgaatccaaacagtttacaagtattagataatgctaccagagtatacactatctgaattctaaaaattcttcgagaaccaaacacagccaaagctagccatgcgtgcgtacgtgcatgatagctgcaaatcagctggtcctgtctgccaaggaggcccaggagccaatcacgtgggcctgtttggttggcttctttccttagccttgctgcgtgacctggatctgctgaagatacgatcaatttcctgcagagcctgatctaagttgttttgaatatcgtgcaagcctagctccacatttatacatagacaactaaacacacacctcacatgtgtagagtctaattaataacagccaaacaacagcatattgtatcccacgatgtaaacccagtaaatatatgcaagcaaacgcacagcagggcatggtggagcggagagaggggtggtggcgctgacggtgctacgacgagaccagctagagcgtgggtgaggcggtgccagtgccagaccaccgccagcgccatgggcgacactaatgccgcctgtggctgcggtcggggccagtggccagtggccagtgcacggaggcgggaggcgctggaagcgaggagcccaatgcggtgaggggacgggagcgggacagtcgataaagagaatagaatctgtgaacggtttatttttcactagtgatatggtcgctaattttagtcaacttcagaaattttaggtaaatctagagtatttactgtatatagggctctgctaaacatgcatgaccgtatatgcttgcatgcatgcggccccggccgtgtggatcggagtcggagcactagaaagtacgtgtgttccgtttcgttgttaccatatgtcccttgcctttgactttgagagcagtctgcgattcacaacaggcgtgcgtggccaggcaaaacgatactaatagtgacgcgcttccgttagaatctattataaaaaatagatttaaagatatctatcaaaatgatactaattatatactaaaaacattaacattttcttatatatatttggtaaaaaatttaaaatagttgacttctcgaatgatgataatatcaactattttaggatgcatggagatggtatgctgtacttaaaaacgttatatcattacttcacattcgatttttaaaacactactacatatttcatgtgccgagaggcgacttacataagcaggtaacctagtcgtctctaatttttcgtttctataaaatcggtgattcatagagagacggatgtcaaactgcctctagaaattttatttacaaagtgatttgtacaggcggatgggctctagaactgcctttatatataagtt

SEQ ID NO: 5274 - DNA, 1802 bp, Zea mays
  misc_feature (1)..(100): optimal_loci_82185_G1, chr2:182877281..182879082, Cluster 32
gcaaccatttgtggagatgccgttgttttcaagtgcctctatataacttcttcgttaattttgtgaaaatttccttgtcaaaacttaaactcaatttatgatttctgactttctgtgcacacatatatatacgcaataaatagtactttatcagactttgggtcatatggaaatagatgttcatgtgtactggagtgtatttcatcgacagagctccaacatgttgtcatcttccagtttcttgttctcaatacttaacttcttacaccaatataacgcatgaaacaaaatccaaaatattttttttgtgtataacacatacatgtatatatatcttctaattaatacgacgaaataaagtatatacaattccttacccctggtcgaataatgtctctggtatcttcattttaccttcatatactcgcagatataataatatcatccatattgtccacttccactacgttccttaattatgacactacatatatattgatgcatcgtgtattatatatgaacatacaatctactaggtcagaaacatatatcatctaaaataacttaattagtatatagaaatttgccatgtattatgttttgattataatgcatggtttcatttaggattatgtttccctccaattacattaatatagtgcttgtacgacctgtttgagtgtattaaacaatccaaattaatattcaaagttgttcttcgcaaccatatattaataccttttaaataaggaagattcagttgtatatatatacatgttgagaatagttaataagtctttgtagattttcttgttcttatatactggaccaaggatccaagctataccttccctgacatcaatgaatatcaaaatgtaatgaacgctacattgaccagagcatacaaatacatttattttagtgtgaaacacaataagtatttagtaaccatgattgaggtacatgttaaatccaaatgtactcaaagttgtagaggcagtaaatgagacctttgtcttcaaatttcttgaactctagcacaatgtataagccaacctcaagcatcccatcacatatgtccctctgacatattgtctctttcttgtcactagtttcctagtgactagctctttactgtctagtgaccacttgttcacgaaatgcaaaggtggtttgagctattctttatgggtagaggaacccaaactcatgtccctttaactttctgcatcttatcttggatgtttcaaataaagtcttaggtgaatacataaacatatgtacacacaaccctaagaaatataaatacaactttattgtacatagaggccccacacatgaattagattaattttcattcaaccaagatgaaaaattgtttgcatgtcatcaaacttgaaggcaattgttctatcaccctgtgctccaaataccttctcctcgaatcttgtgcttatgctattaacatcggtctaaggtgcacacaagtaccaatcatggaacatcctcattgtgcatggatacacttgaagacactaattatttaggaaatgtgttcctcttttattgacctctaggcaatctgtggatcatttgatggtctccatgttagcatacttcctctaaaattcttgtttatgtatgctggtgatgttggcgcctgggttctagggtttcttccttcaaccatggcttatcatgagccaaccatatggatactcttggggcatttgtgtgattaaaagacctcactagcattgttatttttttcgtgcttcactttgaggtgtgggctctatcaa

SEQ ID NO: 5275 - DNA, 1548 bp, Zea mays
  misc_feature (1)..(100): optimal_loci_82335_G1, chr2:183614981..183616528, Cluster 32
tttgcccctacccttgtcactagactcgaacatcttcatctcatcatatattcctaataaggtatacaaggaatgcaaccaaaaacacatgacatgtggtgttgcttattcataaggcatatagaggacttgtttggtgccatatgtgatgaatgccacctcatgtgtggatacctgatccttcactaggtccttcacagaactatgttataccttatttctcttgtgagccattgagaactcaagcaaccactacaatgggtctatcatgtgttctgcgtcattgcttatgcgagctaccaagaactcaaacaatggaatgtgagtggtagtttctactcagctattgcctagccatgtgattggtctgggtgcgatagatctaggagaaaaaatttaattgattgtgtataaaatcgaagatggtgtccttcatatcatgtacctccctcaatcatagttagtaggatagaactaagcatcaaactacttaagatagttgcaccgccactcggtgcaattttaaatatactgatatatttagctaaaacagaaaaataatttatagctcagtggtgacaactcttctcaccaagaggcatgtttaggtcttggacctatttgttgcactttcccctcttaggttcactattatacaagatagtccacccacatttgttttccaatagtccattgcctgaatttttagtggttttccaaaaaatcagttcatccaatgttctagtcgggttgcacatctaatcttttatctaaattagattggctgaggccccggttctagtttttattgtgaaaccaccaacctattttggtcctaataactatgctctagttacattgtagtagtaatctccatataccaatgaaatacctctaggtgaaggccctttattttgattccaccacacgagcgacaaaaacatgtttaatgttgcattgtacttgtaggtgcgccttatgaaggtcatcctttgtaatggctaggttgattgtatgttcattgaaattgtgtgatattgtgtttcatttgtgattcttgcacaatttgtacctcatgccaggtaggtgttattgttattcatggttatggcacatgaaattttagccccatgcccaacatggtgttggatgatatataatttaggtaggtagtttgtcataattttaccatggtgtttgaaattaaccagttgccatgtgtttgtaactaggacaataattgggttgttcaacatgagtgatgcatatacctctagtagcttaagcactcaaaatgcaaggggtttatcattagtgttcttcatgttaggaatgttcaatcgagttcttacaacagagaaatcaagagagagagagagagattgatgggatagcgctatgctaatcttaggttcgatctggtcatgtttgaaccggccgagttgtcccttctactagaacacatacattcccttatgtactgggtggtgatgggaatatagatcatagaatatctaaggctttcctaaggttcctagcccaatgctt

SEQ ID NO: 5276 - DNA, 2486 bp, Zea mays
  misc_feature (1)..(100): optimal_loci_82739_G1, chr2:185773884..185776369, Cluster 32
tgtcagatactcagacgtactcgtgtacgtacgccatatatgcattgattgcgtgcaaaggttcagcatccgagcggagggagggtcgcgccgtagtggttccatcggcgcctcggtctcacgcggtcggcgccgtagtgcccaggattcagaaagcttgggcggtctggtgaaggagcgggatcatggtgagctttgtaaacgacgtggctcgacatgcttctagacatgccgctcgcagtcagcatgctcctctgccctgctctgtaaaactttgcacgcaaaaccttgtgctttccagatatactgtccgtcaatgatcactcgcagcccagcaggtacccgctccctggtatgtcccttatatatacgcacgacttccatcagcaattcagcagtgtactccaaagtcaaaagcctaacctctttgtctttgccccggcctggggagtatttgcaccggaatacgtagaatcagaatgtgcggtaggtatatatggggcgcggtaataaaatttaggtcagaatgctagttaggctagttcagtaacgatcatactcttgttattcttcatcaggttctatgtaacttgtccgacccagacgaatctgttcaaaagaagaaatacaaatcaacgtagctagggacaagcaatgcgtcgccagctgagaaggtggatcaaaataacatgaacttcacctgagcaaatgtatagattgcctggacaatcatagcataatccgtgcccagcgtttgaatcaaaatatcagccaagagtgtcccccccccccccccccccccacaatctgagcaaagttaagtgcacaaggaaggatattttaattagtaataagcacgatataccactccctgaagggattctgatttatacggtttgtggcccaaggtcgatactaacggcctgtttgaagacactgtttttcaaaccatggtttataatgccttactttaccaggtataatgatgcaattatgatataatttatatgattgtagagcagcagaggagagggcaagattgtggttgtcgcttccctgtcgccagtaaaaaactttgatccacaccaaagctttttagaccccaaaaaattatagtattggtgaaaccatggtttatagcacttagtctctaaatatgctacgtactaaacgtctctataaatagagctaacgcctctaaaattttagtagctattttgagatatgctaaggatttcttatcattgttaacaagatttcttgtcgcctaaaatctatttgtttatgtagtagtgtacttggtgaagccttctttcggtgggtctatacgccagaagtttaattagtatacttttgtaaatttaattgttgtagctacattttaattgaggatcttgaaattgaaaattagtatatcttagttacttctacactacattgtactcgttctatttaaaattttaagttgttttagttttaacagaatggatacaaaaaatatcaaaacctgtacaaaaccaaataagattcattatatatatacacatgaaatatgttttgatagtgcatttattcgatattatagattatagcataccttttttgtaattttgatgaaaagtaaacaagttgactcaggataaaactaaaccaattatagctcaaaaatgtaggagtaataaccgttcaaaaggtcagtaaaagctttacaaggttgcagccttgcagttgcagggcaacttccacggggagcagttacatgcaataatgcataaacaaagagctactattcatgaaagaacgacgtactgaccgaatgccattcgacaccaaatcaaatcaatccttagccttaaaaatatactggtagtacataaatcattagacctgttttctcaaaagaagatgaaaagttgacgcatgcactcgatcttgcccatccagtcgacttggtccactctagattgctaaatggttcatatagtaccttgccttgagtgaacaacacatcgctttttatcctggcacgttttgatgctattgaaatcatattatctgtctattatattaatacaataggcttaaataagtcgacatatttacccagaggatcaaaaaattacaagattaataaaaaaaactaaagaacatgcaatattgatttttatagcctaaatttaaccaacgagttcatatacccaaaacaattagtatatcgctaaattcggaatcaaaaaaaagccaacttgaattgtttacaacttgagaaacaaaatatatgtacgaatatcatagtgattcctattctgagacgggagaagtacgcaatttgtgcaggttaccttgctagttcgtggttgttgtttttttaccatgttatttgggacgatatgtaaggccaagattcagcagctagcggatgcagagctagggttggcagaaagcgagaaagctctctcagaatctcactccagggatgatccgta

SEQ ID NO: 5277 - DNA, 1469 bp, Zea mays
  misc_feature (1)..(100): optimal_loci_83402_G1, chr2:189573676..189575144, Cluster 32
caactgcaacgttaaggccaggcagtgaggaggcgggtgcatcgtaataatcgcctcggatgatcattcgtttggcgtggaagcaagcgtctccatatggtgaagcgtccacctatcagatcccaccaacgatgaacacctcgtgttactatttggatggattagaaaataaaaaggagaggaaaaaaaataaagggaacatgcggtcctcttctatctacaagtttcgaaacccatccgcacgagtgtcatgtaactgtgttgccactgttgcgcccggaaacagttgagttttgagccccgacttcacctgctcaggttttgttcggtgaaattggatgcctggcatcctctcgctcgcgagcacgtgctgccaccggaaaacaacgcgctaacgtagcagtccacaatgacgcaacgttgggccacgacctgttttttttttcctattttgtttcggtccaactagcgaccacggagcggacctatttctctcttggtcctgtctactttcggcccatctagagagggcacagcggatcgatttccctagcgcagcctttttctctgtgctccgcccctttctcctatctatgtccatatgtctgggtccaaaaatacttctagtgcgcctgttacttctcctttagaacagctcagatggaaaaaaaaagagatctagatagctaagacggtagagtgagataaatagcgtatacctttttttataaattttacaacactatggcaagtacactagttagttattaataaggtgattctaatagcagctacactagttcaccacaagcgcgcaagtctagtagtttaatttctattctagttcataatgacaaacaagccaccactactatttgaggacagaaaatatccaaacacagtatataaaaagaataacattgtatcgtacaaaattccacatatccataaacatcacatgccatcctcgtaattcatatgaaaagtctttcctcactctatattaaaatatcacagtcacgagtttacacgagggtactgtggtcattatccttctcttttaaccggtgcttgtgaacgattagtattccgcgagcacatccgtgcacctagcaagggttctttgacttttgtcctttacggcttagagtaatttatacttctcattgagtcttcgtaggataaccgacagcatgtccatatatagccttcctaggtgaaggcttcgtagataattggtttcatgctcatagccttctaggtaaggcttcacatgtctccccttttttacttttgagctttgattgctttatctatcacgaagccaattcctgttgatgagaaatgtacgttagttaactctaaattattgaggggcatgtttgcctatggcaaaatcctccacagttacccctcatggacaaagaactactgggaaggtctaaatcccgtgatgtcttgatttcttg

SEQ ID NO: 5278 - DNA, 3351 bp, Zea mays
  misc_feature (1)..(100): optimal_loci_83838_G1, chr2:192129353..192132703, Cluster 32
cgtctatacatatgcgtttggttatgggacaacttggttgcgggagagctgagaacatatagatagaagcgtcacttccaattttaatggataactgagaacaatactggaataattctgtttcaacttgtaaccctaaaccaaacaaccttacttaattgatcgtcctatcccattgtttttgtcattacaaccaaatgcatctacaagtacttggtgagcgcattatcgtcgtccgattccaatgcagtagcagtgaagcagtaggccaaagccgctagctcgatcgttcggctgtgctgtggggtaggatctttgctcaaactttcaaaaccaagtacggacacagttgtacggggttttttttggggtaaaactgaaaacatttgtttctcttatcttattctctatcaccttttttctgagaaccttatcctactaaatgtttatgaaaccagatttaactgtacacctgattttacctgagctgtaaaaaaactgaaatgccaacagcagccgcctgtctcctgcacagtgggaagcaagcaatccaactgcccgctcaatcgctcattgatgagttgggatcccactcggcgccactcgccgccgcagtaataagcagcagccccatttctatttccctcgcactcccatcgctgcaggctgcagcgcatcatgcatatatatgcttccacgtatcattcgctgttgctcgtactgtatggtggcagtggcatgcattgatgcatatgctaacgctatgcatgcttttctgattactgttacgtgttgcccaccccccctccatctcatataggccatagcgccagcagggaaccacgcaccaatgctctcagattactgttacctactgcagtagccagtaggcagtagctaggcgctagcaataaatatcgaggtcgatcgacagtcgacacgagaaaaaaagttcacgctgattaattaccactctactactgtactactactagtagtcaacaaaggaattcatgcacatgatgcattggccaagccatgataaattaatcactcataatcatatagatatattcatggttggttggcaacaaattaaagaaaccgaccatatggtggtctctaacaattaacatctgatccacgtacgtacagcattcctcatgctttgacagtcagcttcacacgcatggcaataataattagcagcccccttatggtagcacgctagcttttctgtggacacgactagagcctgctagctcgcttgttcttcgcaatcaggccggtgacgacccgacaaccctaaccactgtatatggtatatgacctgatcgaagccgcgcgcacctgttacagaccacattttactgtcacactactgtactagcttgttgtgttgtttggtcaaggtcaaagacgtctctcccatcgatctgtatggtcggcatttgtcaaagttgaaagaagactggcctcttgcgttcggttagcagaaaatgcatgatgatttcacgtggttgacatgcatgatgggaacacttgttccaagcgtaactagcacggttaacttgcgtcgatcgttggggacctgatttccgtggcacgtgcatcgttgcatataaatactgttctcatatatataccagttatatatgacgtagcaacaagacgagcaccccaaaaaaaagggacaaaaccaaccagccccatgcccctgaagccaggccacaaaccagactgacacgtacgattattcccttctcgacatctccctctctctctctcccatgcacccgaaacttcggtgctcaaaaccatcacacacccaggaaggtttggagccacacgtggcgacaatacgcaagctgatgccttaataacgttaattaaaaaatgtacttgttgtgttggagaaatggaccatggaccagcaaactgtctctctctctcttttcctcggagaaaagaacatgcatgcatgctggtatcttggatttggggagactgaagaagtattcaggtgcaagcttgcttgcttagctcagggagttctttatgggatcagactctgtgtgtgtgtgtgtgatgggtgcacccatgttgttaattagtttagctttgtctataagatactgctaactgtactcttccctaatctcaaaaaaagaaaagaaactgtactcttccctaatctcagaaaaaaataaactgtacacttccctggcaagggggagcagtgtcaaaggcaattgaatattcttgtcgatgcagaccgagtatttatgcatacactatcccttttagatgaagcacgtgcatttcttcatgttgaacaaggggagtcgctttatatatatatgaacacaatctaattaagtaattaattaaccatcaccgtacggtacggtactgtgttagcacagcagccttgttgaacagaagcgaagcgtgtgatgttgttctcttaggagataaattagttttcaaaccatatatataatattaatatgcaacttcgcaaaaactactgtagcacagcaaccctcacatggtcagcaaacatgagcgtgcatgcatccacgaaaaagtgtctgcggcgcacgcgcacctcgccggcagagcaggcaacggcaatcaccgtccacggtaggagccacagtaaagcgctgttttttttttcaagggaaaagcactactacttcggttccccccactcaaccaaccaacctctctcgctaacaagaagccaagaaaagtaatgctcccctctcctcttctcccccctgcaaaccaggtagcgagacccaaaccaaccggccccttcccaataattgcacgcaacaagcacaagggttctccatgctggtgttaaaggatgaacatggccccctcacctttagaatccctgacagggattgatggcctgatgaatagcaacaaacaaaaatccatatggaaaaaacagaaaatagtttttttattgtcataatacaataagtggatgcatatcatccacaccctcaaattagtataatatggccatgcatatcatccacaccctcaggtgaggcttaggctaattccaactatttcccccctcttttatatccctattcatactttatatttattttttaaataccccctctttcatttctccactatttcttctcctctccaacaattctttctattaagcttcgctttacactttaattaagctatttaactttttgtacgtatgtgtttttgggtttttaaaaatatgcaatatttatagtaccgtgatacacatttttatctaataattaaacttaatatcattgattggtgaagaggtgagattag

SEQ ID NO: 5279 - DNA, 2350 bp, Zea mays
  misc_feature (1)..(100): optimal_loci_857_G1, chr1:4550323..4552672, Cluster 32
tcagttttttcccgctcggtcacagtaagagaggaagatatatagaagaatctcagcatgcatgctcacattgcgtgtgtcgttgcacagtgcatatactatagctagcagcattgcaaaaggcaatacaaagaactcgttaacatgtggggccggccggggaacaagagctcgtcatcacatcacacaatgcaagtgttactgtacagtgtactgagtaagtagtatatatgctttgaagaaccatgttaatctgggtctgacttcgactcatttcggtacccgtacgtatatatatacatagctagtgtcatgcgtagagttcatggctcccagtcctgagagggctccgtgcattgcatgacagcatgagcaggctctggcattgctcagtgtcactcattattaggccttaattagtgcaggggccgtacgctagctgttccgtccctagatgatgtaagatttttgctggtaattacggttctctccttggttttagcagtccagtcccaacacgggatcatgagctcgtagttttattagcacttggacactcgctgcatatatatactcagccattttccgtcacatataatctgaggcatagtggtttccttccgatccttcctatccttcccggccgggcattctttatttgttattccaggagagcgtcaatatttttagcacatatacatgtgcattattattctttgtttttttaaaaagcttccagtactagtatatatgttgcctgaaaaaactaccagcacataacgatggttagttacgacccacacgtgcatgcgtgtgagatatagatcgacttgcgagatgatcttgtcaatttggtatatgatgtgcacaaaaatacaaacgtgtcctggcttggaaccgttttgagtgtgtaatctctcatgttttttgcattagaaagatgaggagttgaggacgcatgtatggtgatttatatcttgcattcatatccaagcagactctatgtggtaaactctcatggttcgatcggctgcaaatattaattcaaatagcctcctgctttctgagccttattagttgttttctattttaataaacagaaaaaaataatgctgttactgttagcagctggagtttgtttatgtacatgagttcttgagtcctctaagtctagtgatctcttttcaagggaacaaaatagtctgattattatatactctgaacattgtatctgcatttattcacaaaaacaacgatgctattttacttccagtgccacaaactagtagctgctgcctgctggtactaaaaacgaaatggcattgatatactatatagtagtttgctactgccttgtaatatagtgcacgatgacaactagtgcttagtaaatcttttaattaattaaggtagcaatgtgttttcttgtcaactgttaatgcttatttgttcacagtaagcattttcattaagaagatcattccatgaatacatagttcatttgccttaaatgtagaccatcaaattattattttttgattgatcacatgaacttgttgccataacagaagtaaacatatggaagaaatactgacagtcagcacacgtgggattgggttatctttgatttggtggcgtggggagatcatgtaccacacttcataagaataatctatatattaagaatatttttcgttttacatatcaaattgagtcaccgttactgaagtactaggctaatttgttgcatatacatgttggaaaatattaaagtaatcactttaagggtataattatagggaattgcaattggaaagaattaagagggactatcatccatagctacggtgtatatgtgtagctagcgatcggatcagtgcactgcttctcattccaagcttattagcatgagattttctttatcaaccttcaaaagtaaccactgaatataaccaaagactagagagcctataaaatttggtacctccggtatatatatttatcaaactcaattattacttatgtttcttttcaaagaccataaataatctctctttcatcacaaaataaataaacatctctattggaaatgaagcaaagagggcaataataatatattatgctgttccaagtatatatgtagttctcatgaaaaacatgaagaacttaaatgggaaaccagaaacgtcctcttcatgtgagttgggatcttcttccctcaaagtttccatcaatgtcatgaaagtgaagtgtgaatatataggtgagtatagatacctagctagctagccaatgtccacgagcaagacaacgacatgctgatcatcttgcccttcttcctttaatttgc

SEQ ID NO: 5280 - DNA, 1701 bp, Zea mays
  misc_feature (1)..(100): optimal_loci_87839_G1, chr2:215996014..215997714, Cluster 32
agcaggttcatgttatattattactcgacgggcgagaaaagcccgcgttgatctttcacatatagtttggagcatattttgtaaattaaggctgttcttggagtgtacaaattaacgacgggcgagaaaagcgcgcgttgatctttcacatatagtttgaagcatcttttgtaaattaaggctgttcttggagtgtacaaattaaagccttgactttccggccgtcctcacgaaaacaaaaggcaagcttggatccttatgaaaacaaaacaaaaggatcggagctgcatgcttttggtgcaactctatcgaggagtcgaggatggatgcatgcatgcatgtagaggtagctagtgcacgatcttgtctctgctggtgaccttgacttctttcccctaccccggccggccggccggccaggccatctcgtacgtgtgtggaattcggcatgtgcatatgatagcatgtcaagccctagctcgaattaatacatctggaaaggcgtgaggttggagaagggtggtctttcaactgaagaggggaggaacgaaaacaatcaagtttgttaatttgcagagagaccagaagtagtagaggagtagtaattatgatgggggaggagcacggcacacaaggcacatgcatgttgttgtccatttcaccgggttttgtgggtggtctctgcactactttgactttagggtttagtgcaaaagacaagctcactaaattaacaaaatggtagaagaaaaaggtagagaaagaccaccttgcattggggcatgcatgcatggtggtttgaataaagcagtgcagtgtcaggaagacgacagatgcatgagatgagagtttgtgttatttaaaccctgatagcgaaaaaagagcgatcatcgctcacgtacgaaactaatattattaataattagcaagcaagctccccagacttaagctcgctttaatcatttcaaatttgaactgtcagttcagtttgtaggatcttcaattattcattcgttctggcccgggaacttgaacgttttgtgtgattgttttctcgcgtgttaggacatataaacctagctaagacgccaagaccgaccggaaattaactagctagctaggcacacacggtaggttctttgtattggtcaaagtggtctcgagacgtttgtgtatgtggccgaccaatgcaagtaaaaccgacgaggactgtgttacgtcaaacacctcgtcaagtcgtcgtcatttaagcatcagctagcagacaagaggcaacggatgttttgttgagaaacgtttcattaatatacaaggggagaacaagaagcctcctgtgtagtgccgggcacatgttttgtcggagcagaaactgacaagagttcccctgagacctagctagcgatagcaaataagcatggtcatggatgcccgtgcatagtgctacccccagtacatatacccaccaactactacgtaccactattccttggcgcgtggaaaaacgcaggcaggcaagggtcgtcgtagctaccttaattatattagctgcatcatatccatgagtacacgtgactagtagctagacgggcaagaatcgaatcagggtttaaaaaaaatcatgcatccttgttaatataaggagaggttcaagcttaaaaagcacatttacaaataagtaatttccactgaaaaagaccgctt

SEQ ID NO: 5281 - DNA, 1915 bp, Zea mays
  misc_feature (1)..(100): optimal_loci_89953_G1, chr2:226417850..226419764, Cluster 32
aaagatatatctcttaattgcttgcatgtattaatggatggttataaaatgacttcacccactcttcttcttctccatgacctcacccacttgatcccttcaagtgcggtgagccggtgaccaagtcttcaggagaattccatttttcgagtgcaaggttttgatcttgtttcttgtggagttgttcataggaggttatcatgtgccagcatataacattttcgtgctatttttcaagttttaatcttgtttctaggtctagatctaattaactggtggaaaacgacaggaagagaacctgtgtgtcaagtgcttaaaaaatataaaaaatcatggtaccaagttaaatgctgcattgacatgtcttggagggtttcaatatggcttctagtatcaaacatttctttgcctaagtccaagaactacactatatattgcatccatttgaaaaataccttgcatactagcaaacaacattattagttcatatagtcatattattcaccaaacactaaaatccaaaatccaaacgtaataggccatagagctcattttccttgcaccgcgcgtgttcatcctctctctagctagccaccataaaaaaaatggctctgcactgtgatgacgatgcctacatgtaaacaaaactgatgttagcaatgagttcaaaaaattctgagcaagttctttatgattttaaaaacctaccactggttttagcaaactacaacttttgggtctatttaagaagcatacaactatttttttacacatcacaatcacgttgaaaaaaaataaacaaaaataaaactatattttttcccttgctttagtgatgatcgaagcagtagtaggcccttgagcaatttattgtttcttgcaacaagatgtcaaatatgccatgaattactcctttttccgacatgagatggaagctgaaaattggaaccaatttacagtcgaccactttcactacattataacaacaacataagattagatatgcaggatcaagccgagagagtcacaactacaccacctgcctgtatacacgcctcctaccaaaatcttatgtacccaataaaaaaaaaccttcgcccaaaaatgaagaaatatttgccctcagcatccaatttcccccctgacaactgagtttcccccctgacaatataaattccttttcctcccttttttgggctgctcctctcacaccatgaggccaggccagctaattagaaatttcaattgtaaattttgaccggcttctcgtacgagtgacggttctgcaggtagttaaaatcaccggaaggaagttagaattacacagcctaacctgaatacagaacatgatacgaatgctacacattgaagtgcataaaaagccagtgaagacatgaaaccgtgcatgccacaattcgaaaaaatggtctcagaaaatatatgaataaatttcatttcaaatgcctttcttgggtggcagcggttaagaaaccattctaggcaccagagctcaagcatagattcatataaaatggattgaaaaacagtccctacattatcaagcagactgaaggatactttaactcattcactcaaaatggcaaatggctacagcagacctcataaagatgaagctattaagatcataaagcactgcatgtttgccacaggcgccggtctggagatccccaacgagcagcgccgcggcggcaccccggcggacgccgaggccaacaacgctccggacacggcgcgggacgttgtccaagcgctccgcgagccccaacaaattccagagcccgacccaaacggcagcgcagttccttcggcttggcttctgtcacaaggtaagggaaacatcaaagactctagggaacggggacaagtgacggactatctccaccaacttacattc

SEQ ID NO: 5282 - DNA, 1460 bp, Zea mays
  misc_feature (1)..(100): optimal_loci_92974_G1, chr3:4750227..4751686, Cluster 32
tggtaacgtagttctcaacactttggacccgtttgttggagcttttagacgtgaagttcaaacaaaccgttaggtatctagtttagctttcataaagtcaaaggtaaaaaatctaaatttatatagaagtctataaaatctgattttacaagtttttttagttctataagttagaaagctaataatattatcaaaaaatattgttgattttttaataaaaaaaccaacgacttttctagtaaagctccaaaattgcaactcaaacagacatgatctttatctcatgaggctggttctatcctgtagggttatatctaccaccacatcaactatcaatcatattatcgattctgctccaccgcacttcacctcaacgttacgtcggcttttttatatacttttagttaacataaagcacattattttattaatatatagatatatctaattatataattaaacaaataaaatgtacataatttattcaatcaaataaaaattacataagttaagaaaataaatatatacatataattcataaaaataaaaataactctttctcatctttctctcctaggacttccgcatcatctaagtttaattattttgtcaaccttttaaggttagcttgtagaatatttttattgccttttttctattataaagatagccattcctttagatgactagaggttggttggcttgtcaaggaaatcacgtcaccttattccggtgccttcctggtgatctaggggctggctcatcttcttgtagggtagtcgatccatacaaaatcgttaggttctcgatctgtcatttgtgcattttgaaaatcctatgttgccaatgagccaggtagttcccgaaggataggtacgtccagccaacgcactccgtacgtgtagaatttccctggcacctgcctttggctaccatgcgttttataccgtacgtaggcacatagtcagtattgcgtgaccaccttgtgcatgcagatgcagcatccctgatgcccaaacctaagaactatatattggagccaagaaaaattcgattttcaaattcgagaaaggggtgtatgcatgcatgcttcgaaattgaaattgaacgagcgtaatacatggacgcggggcggcgttaaacatgtctcaggccacgagcccacggctgactgaaagccatatataccaaggaggtcgggtaccaatgctcacccgccaactcagcactggggacgagatctcggcgcggtctatattgatgttgaaacgtgtaaccttgatgccaatgccaatgatatataatggcgtcgagataaagatttatttttaaattcaaatcagaaaggacgtagttgtaaaaatctttcgcaaaaatgatcaaaaagcaaaaaaaaaaaagacggacaaatggatatgtttctacttctgctaacgcatggttaatgaaaattgatattg

SEQ ID NO: 5283 - DNA, 1953 bp, Zea mays
  misc_feature (1)..(100): optimal_loci_94089_G1, chr3:10006057..10008009, Cluster 32
catactgccctaagtcccctatgggctatgggctcagacctagtctcctaattaatatataagttcattacatttatatcatccacatcatcgtcacatgcagctgcagcagtttcatcatttgtagcaagagcttggctatagtaatctttaacatgtagattatgaggagcaataaagtcaattttagcttcttcctcttttcctaatccagtcaaggtctctcagctgctctagattctacttaatggtcgtggctacaatgcttcaatagcgcgtccttgatctaaaaagtagttgataggcgaggtacccaagagagtttccagccaaggtctctcagctgctctagaaattagtgcatggctcgtccgtgtgggctttgagacttgatgttccactaacctaggccttcaagaaaatcagagataatctatggtctaactgatatataaccattagtagccttccaacatctcgagtgtaacaaatacaatcaaggtgttggaggaaaaagcttaaacataaaaaaacaacttggatatttatgagttgagtatgatcatgtcatcttcgagatgtagtcaataatcattgggttaggtggcaatccaaattgatggccatagcctcggctagttgggtggtagggaacttaggtttgactcgcataatgattcggcctgtggaggaatagatatcatcctctccaagatggttcaaccacataatatttgtagaaaaatcttgatggaatcatcttgtcatagctacacatccacttctagtttacttgattgattaccagaaagtccacaaggactccaatccatcgtatgtatccaatccatcgtatgtgaaacacaatacctatccccatgccaagtagtaatgccttgtattctttaaaattgttggagctaagaaagtacatctacaggcagtaattgtatcttgatcctctagtagttcggtcaaaaatcgagcccgggtcaaaatagagactaggttcggatcctagtttgagttgaagtcgatattagggtcgaatctgagtctaatttaatgtcaaagtcaaatatgagtctatgtcgaggttgagatcgaatctaagtcaagtcaaagtcatacttggagtcaagtccaattcgatgttgaggttgaggttgaacctgaacccaagtcgaagttgaggttggagtcgagtctggttccaagactccaattcatagtagaggctagagtcaagtttgagtccaaaccaaagttgaggctaaatccaagtccaagtcggcatagtcaaagttggagtcgattgtgagtccaagtcaatatcgaagctggagtcaagtttgactccaatctatgtcgaagttggagttaagtcaaagtccaagttgaagtcgagactgaatttgagtccaagttgtatcaaagctggagttgagtcagagtccaagtcaatttcaaagctggagtcaagttcgagtcaaagttgaagccgagactaaatctgaatccaagtgaatatcaaagctggagtcgattctgagtccaagtcaatgtcaaagctgcagccgagaccaattccaagtcaatgtcaaagttggagtccaattcaagtccaagtcgaggtcaaggttcaatttgagcccaagtcaatattgaagttggagtcgagtcaaattccaaatcaatgtcgaagttggagtcaagtttgagtccaagtctatgtcgaagttggagtcgagtcgaagtcctaaatcaaagttgatatcaaatccgagtctaagtcgatatcgaagctagagtcaagtttgagtccaagacaatgttgaagatgcagtcgagtttaagtccaagtcgatgtcaaagtcggagtcgagtttgagtcctaagtcgaagttggagtcgagattggaattgaatcctagtccaagttggtgtcgaaga

SEQ ID NO: 5284 - DNA, 1516 bp, Zea mays
  misc_feature (1)..(100): optimal_loci_96444_G1, chr3:23005795..23007310, Cluster 32
atcgccatggcaaaccaaccacgatgatataacagcaacaaacaaaagcggtgcttagtggagtcccatgtggaccctataattgtatggaccttttaatcatctttttttttcgtcctctgcatggcgctgctgcatgctgcttgcacacacttattgcaaagtaccgaagtggcgatagttacatacttctagtgtattcaaattgctgtcacgaaggcaatggcccgtattggtttcctcgagctagcacattttctggtgaaaaaaaaactagctagcgttttggtagaaaacacgtgaattacgaagaactttgatgctgtaatgaatggcgtaacagtgcacatcatacagtaattacaacttagaaaatacagaactgaagtatagaacaaaacatagcttctaaaaagagaaaaatcaagaaataccagtgctataattaatgatcgaaacaagtgcatatcatactttcatattgaactcgatcagaaactcatgaattgcagtacgtagtatagatcaaaacataattatcaaacagacaaaagcaaaagaacattgatgctaatgaaataattgcagattgtaccatatccgtgactatcagctataaaaaataaccccaacaaacatcgttctgctacagtattaagtgcaagcaaaaccctacagtttcaactcacactatatatcgtatgcattgcaacatcgcgcgcggcgcagcaaattgtaagtattaaatagaaatgtagttgcaaaataataataaaaaatagttcgatagcaacctccatgcatgcatgtttgcacgaattctgtctcgagaaagtagtcttaatcagagtagagtaagacttagagtgaagcgtagttaaaaaaaaacagtccagtaactgcatgtgcttacgtaccctagttcgttcgttgttccagactggaaggcgtttcggttgaagcctagctagtctcggtcttgtcgtggacacggtcgagggcatctatgcgggaacgttccttttgagcttgacgacaatcacaaggcgacgtcgtcgcttggacaagtccaatcgcgctactgccactctgttggcataaataaatatatacaaacgaacgacaacaactgttttggccttcgtttcaaacgaaggaagaagaagaaagtttttggcctgctctgcctgtgatgatccacgtacgtacgtagtacacagcacgccctctgatgattcacgtttcgtgctggtaaaagatgctaggagtcaaggactgatccgtataaaatactgaaagctttcatgcagctggactattcagccatggaaacgtgtattgctgagtgcacgaagtcctgatacgtacttatcgtcccgttgctttgcaacaaagtatagttaatgtgacttcagaaaaaaaaactttactcgcgctcgtattccctctaacctcacattagggcgtccgcaatgactatctcaactagctagctgatgtagagcgagagtggatc

SEQ ID NO: 5285 - DNA, 2092 bp, Zea mays
  misc_feature (1)..(100): optimal_loci_96999_G1, chr3:26090114..26092205, Cluster 32
tttaagaaccgatacgaaaggtcttttttcggcttccatccaaaatctttactgattctttataagaatcggtactaaagtacccatataactttggtttctgcccaaaattttcagttagcttgtggatctgaacaaatttggatctacaagctgctaaaagttagccgaggtcttgtttgggtcccaagctaatagtttggctattatcttaccaccacctagctaataattagcaattattattttttatgttttgctattaatactgctaatgttagctgagaggatcccgttagccacctgcttgtcgatcgaactatcgaagcaacggaaggatatgtttgctcacatcgccccaagcccaaacctaactttgccatctccaacatcacaggggatcggaagtcaacagtgatttcggcaaattatttaatacgcctgtggaaatcaggtaggtcgacgtgcggatccgatggacgaccggcaaaagctttgtttgtgctcgttcaatatataattcttttaggcttttttaactataactttgatcactcgtcttatttaaattatagacatgcaaaatttgaagccaaatgtaaacaaaaccacaatgttttttgtttgttttctataaattttttaataagacaggtggttaaagttagaattaaagaagccaaatcaattataaattggaaaggggagagtacatataataatttctgatccgggttgagttgacaaaagcttttttgggtcaaacattgtcgtaggggtgcgtgttaactgcattctctctctgctactgtatgttactgatctagtatcagagaaccgtatagccatgcatttgattaattagcttccagctggctgtagcacgataatcatacacaggagattttagagataagctagtcgtagtatacgtttctaattgatagttccatgtacgtgacgaccactcggtgcccatgatgacggtgcatgtagaatggcactaccacacttggagtcgaagcatcctccaactccaaaccacacattctggccgtggatctatgtgatgatgaattcatctccactccttcaataataacaacagttattagatccaagaaccagaaaaaagaggtcgttgcaaaaaggcagggctgactatatattactggaagctcatgcaagcaagcatgacatgcatgtaatgaatatctgaatatatagttggcaccacgttggtcgtcaaatcgataaatgattagatatggggacgaacatgcctggcgagaggtcctcacgtccggacttcattgactccagaagctaacgttatcggttggttgtgttctagctagctagctagtcgacgacgaaaccatggcatgcatgagctgttcagatccgatctgcttcgatcttcaccgaaatcgacgtgcgtgtttgcgtcgaccatgaaggacagcctgacatgtttgatggtacacacattaggagacaatatttcatatttgtgtcgaatgctattttaggataaaattttagatcttagaaatttgttcatttgaagatggtgggagtacatgcataattcctccgtccgtactagaattcaaaggaatttgtgtggcctagggaaaaaaatcatagcgagtttggccatgtttattagaaaaaagagataatttttatgatctcatcagtttcatcagctgcattatgaaacagtttttataatttacatcttcgatagatatcagtatatatttttgtatcaattttgtcagaatttaaattatttgatattagaacacaacatgcagctggcccgttcatagattgtactaataacaaaaaggacccccttacctaacagaatagtatggagcaactctatgtactttgctggtccgttcatagattgtgtgctaataagcaaggtatgtgtaccaaatacaacccttgtctccatgaagcgaacaaaaagactagactattaacaaaaagttaaagttgctacattttttaatatcaaaataaggtgaacgcttttttcttttcaaaatcatttctgtatagggtaagatacatg

SEQ ID NO: 5286 - DNA, 2284 bp, Zea mays
  misc_feature (1)..(100): optimal_loci_98842_G1, chr3:36690988..36693271, Cluster 32
atatatattgatgatgtgggcgccgggtagatgtgacatgtatgcatggaggagacatacatgtatatatgttacgtacgttaatagctagctaattaaggggggcactagataccatgatgccgatatatagaagacaaatcaaaggtagcaagagatcagagaacatatgtcttggtttgcatgcagtagtagtagtgtgcagtggggtcgcacagttaggttggttaggtcacaccaaagatgctgtttttattctgaacatcgaaattaattaaacaagagagaaggaacagagggattaaacttgagtctacacaccggagagagatcggagaatatatgcgtatgtatctctctctacacactgtgtaacagttgttagttaaggattctcccattcgatccccggcccaatgcaatgtgcttgataagctacctggaatatatttgcgaaaagaaataaacgaaagatccccacagcccgacactgtagtagaaaagtgtgtgcgataatgtgcagtgcatccgacatacatcgtccatatataattgcaccgtcgtacggaggcctaaaacaaaatatggcaatttgtaaggacaagcactataatatcagagtagggacatctaaattggactgagcagagaaaattaggatgaaaatttagactctagtactacttagaacaaagaaatgagcggggcctgtgctgtacgtgagtgtccgccggaaacaaataatcgttgcatggaatattggaacctggctactgccatattttatgtccggactgaattcgggcgacagagcagtttcgcgcgcgattccaccacgtgtcggtgcaccatcgatcgcggcacgtacgttgcataccgccaaaaaaaagtttctgcatgctttgatgatgcgggatcggatgcacggtggagcggaaatgtttttctgcttaattatctatttaatcttagctacgaaattgtcgtgcacgcattattttgcatatatatacttaataatataaagctaataatcaccctgcctgtgcaagttagataaggattcgatcggctgtcgagcgcgcgatcgagagaaaatatatataatatatacgttgtgtgtcgaatcctactaccagctatagccttttcccccgaaaagaaaacaaaaaggaccggagcggctagccggctaaaattaattctcactcaacaagggaatacgattcacacgctctagtttactatagctctcctttacttagccatcacgcacgcaagagagctgtacgtgctcatcctcagatcgattcttcttttttttagcgaaagggaattcgatcgtcgagatcagccgtgcggcggcctgcttttatcgggaacaaaactgatatatgcccgctccttgtcaagtatatattttgatgtacggcaggaataacatgcgggacgtaggcaggcaagccatctgcaaagagagattttggcttatatatcctggttgcctagtatttgatgtacgtgacctgcttgcattggtacgtatttgctaaaccatcctgctggagagaataatttgtgatagtatgtatgtatatgtatatgtatgtgcggctatctaattcagtaccgtattataattaagagtatatataccatgcactgctagctagttgttctagaagcagtgacgtacaccttaagaacagaattcatgcaaattaaacacagcgcaataagtttgaatctatcactagatccaagtacagagaacatttgcacgctaaatatggagcagaacagcgaggttatgtgcgctctctcccggccggcctcccgcgcgctgttctgatcccttttccgcgtccgtgtgcgcagtggccgccgccgccgccgccgccgccgccgccgccgccgccgccgcgccccgcatccatgtccagcaggccgccgcttgctccctgcccaacggcggcggctgtggaaaccggcgtcgtcgcggagagtgctctcgtttcccagatgtatgcattcttcatatcttgataaattatttttcaatcgtcataatccagtagtaatttcagattgatgaattgtatctttacgctagctaactgtcctaagagtgctgctgctgtccgtaacattcaaagagatttttcattgtctttgcttttgtgtccttcaagtgaataccgaccaaaagaatgatcgtatctattttaattcacatgtgactcacacacattttcaagaacttctcattcgaattgaattgatt

SEQ ID NO: 5287 - protein, 7 aa, Artificial Sequence
  Description of Artificial Sequence: Synthetic peptide
  Zinc Finger Protein Recognition Helices
QSGDLTR

SEQ ID NO: 5288 - protein, 7 aa, Artificial Sequence
  Description of Artificial Sequence: Synthetic peptide
  Zinc Finger Protein Recognition Helices
RKDQLVA

SEQ ID NO: 5289 - protein, 7 aa, Artificial Sequence
  Description of Artificial Sequence: Synthetic peptide
  Zinc Finger Protein Recognition Helices
RSDDLTR

SEQ ID NO: 5290 - protein, 7 aa, Artificial Sequence
  Description of Artificial Sequence: Synthetic peptide
  Zinc Finger Protein Recognition Helices
TSSNRKT

SEQ ID NO: 5291 - protein, 7 aa, Artificial Sequence
  Description of Artificial Sequence: Synthetic peptide
  Zinc Finger Protein Recognition Helices
RSDTLSE

SEQ ID NO: 5292 - protein, 7 aa, Artificial Sequence
  Description of Artificial Sequence: Synthetic peptide
  Zinc Finger Protein Recognition Helices
ARSTRTN

SEQ ID NO: 5293 - protein, 7 aa, Artificial Sequence
  Description of Artificial Sequence: Synthetic peptide
  Zinc Finger Protein Recognition Helices
RSDSLSV

SEQ ID NO: 5294 - protein, 7 aa, Artificial Sequence
  Description of Artificial Sequence: Synthetic peptide
  Zinc Finger Protein Recognition Helices
DRSNRKT

SEQ ID NO: 5295 - protein, 7 aa, Artificial Sequence
  Description of Artificial Sequence: Synthetic peptide
  Zinc Finger Protein Recognition Helices
QSSHLTR

SEQ ID NO: 5296 - protein, 7 aa, Artificial Sequence
  Description of Artificial Sequence: Synthetic peptide
  Zinc Finger Protein Recognition Helices
RSDALAR

SEQ ID NO: 5297 - protein, 7 aa, Artificial Sequence
  Description of Artificial Sequence: Synthetic peptide
  Zinc Finger Protein Recognition Helices
RSDDLTR

SEQ ID NO: 5298 - protein, 7 aa, Artificial Sequence
  Description of Artificial Sequence: Synthetic peptide
  Zinc Finger Protein Recognition Helices
DPSALRK

SEQ ID NO: 5299 - protein, 7 aa, Artificial Sequence
  Description of Artificial Sequence: Synthetic peptide
  Zinc Finger Protein Recognition Helices
RSDNLSQ

SEQ ID NO: 5300 - protein, 7 aa, Artificial Sequence
  Description of Artificial Sequence: Synthetic peptide
  Zinc Finger Protein Recognition Helices
ASNDRKK

SEQ ID NO: 5301 - protein, 7 aa, Artificial Sequence
  Description of Artificial Sequence: Synthetic peptide
  Zinc Finger Protein Recognition Helices
ERGTLAR

SEQ ID NO: 5302 - protein, 7 aa, Artificial Sequence
  Description of Artificial Sequence: Synthetic peptide
  Zinc Finger Protein Recognition Helices
RSDHLSR

SEQ ID NO: 5303 - protein, 7 aa, Artificial Sequence
  Description of Artificial Sequence: Synthetic peptide
  Zinc Finger Protein Recognition Helices
ERGTLAR

SEQ ID NO: 5304 - protein, 7 aa, Artificial Sequence
  Description of Artificial Sequence: Synthetic peptide
  Zinc Finger Protein Recognition Helices
QSGHLSR

SEQ ID NO: 5305 - protein, 7 aa, Artificial Sequence
  Description of Artificial Sequence: Synthetic peptide
  Zinc Finger Protein Recognition Helices
RSANLAR

SEQ ID NO: 5306 - protein, 7 aa, Artificial Sequence
  Description of Artificial Sequence: Synthetic peptide
  Zinc Finger Protein Recognition Helices
DRSDLSR

SEQ ID NO: 5307 - protein, 7 aa, Artificial Sequence
  Description of Artificial Sequence: Synthetic peptide
  Zinc Finger Protein Recognition Helices
RSDTLSQ

SEQ ID NO: 5308 - protein, 7 aa, Artificial Sequence
  Description of Artificial Sequence: Synthetic peptide
  Zinc Finger Protein Recognition Helices
RSADLSR

SEQ ID NO: 5309 - protein, 7 aa, Artificial Sequence
  Description of Artificial Sequence: Synthetic peptide
  Zinc Finger Protein Recognition Helices
DRSNLSR

SEQ ID NO: 5310 - protein, 7 aa, Artificial Sequence
  Description of Artificial Sequence: Synthetic peptide
  Zinc Finger Protein Recognition Helices
NSRNLRN

SEQ ID NO: 5311 - protein, 7 aa, Artificial Sequence
  Description of Artificial Sequence: Synthetic peptide
  Zinc Finger Protein Recognition Helices
RSDSLSV

SEQ ID NO: 5312 - protein, 7 aa, Artificial Sequence
  Description of Artificial Sequence: Synthetic peptide
  Zinc Finger Protein Recognition Helices
DRSHLAR

SEQ ID NO: 5313 - protein, 7 aa, Artificial Sequence
  Description of Artificial Sequence: Synthetic peptide
  Zinc Finger Protein Recognition Helices
DRSNLSR

SEQ ID NO: 5314 - protein, 7 aa, Artificial Sequence
  Description of Artificial Sequence: Synthetic peptide
  Zinc Finger Protein Recognition Helices
RRSDLKR

SEQ ID NO: 5315 - protein, 7 aa, Artificial Sequence
  Description of Artificial Sequence: Synthetic peptide
  Zinc Finger Protein Recognition Helices
RSDTLSE

SEQ ID NO: 5316 - protein, 7 aa, Artificial Sequence
  Description of Artificial Sequence: Synthetic peptide
  Zinc Finger Protein Recognition Helices
QNATRIN

SEQ ID NO: 5317 - protein, 7 aa, Artificial Sequence
  Description of Artificial Sequence: Synthetic peptide
  Zinc Finger Protein Recognition Helices
QSGSLTR

SEQ ID NO: 5318 - protein, 7 aa, Artificial Sequence
  Description of Artificial Sequence: Synthetic peptide
  Zinc Finger Protein Recognition Helices
QSGDLTR

SEQ ID NO: 5319 - protein, 7 aa, Artificial Sequence
  Description of Artificial Sequence: Synthetic peptide
  Zinc Finger Protein Recognition Helices
RSDVLSE

SEQ ID NO: 5320 - protein, 7 aa, Artificial Sequence
  Description of Artificial Sequence: Synthetic peptide
  Zinc Finger Protein Recognition Helices
TRNGLKY

SEQ ID NO: 5321 - protein, 7 aa, Artificial Sequence
  Description of Artificial Sequence: Synthetic peptide
  Zinc Finger Protein Recognition Helices
RSDNLSR

SEQ ID NO: 5322 - protein, 7 aa, Artificial Sequence
  Description of Artificial Sequence: Synthetic peptide
  Zinc Finger Protein Recognition Helices
DNSNRKT

SEQ ID NO: 5323 - protein, 7 aa, Artificial Sequence
  Description of Artificial Sequence: Synthetic peptide
  Zinc Finger Protein Recognition Helices
QNAHRKT

SEQ ID NO: 5324 - protein, 7 aa, Artificial Sequence
  Description of Artificial Sequence: Synthetic peptide
  Zinc Finger Protein Recognition Helices
QKATRIT

SEQ ID NO: 5325 - protein, 7 aa, Artificial Sequence
  Description of Artificial Sequence: Synthetic peptide
  Zinc Finger Protein Recognition Helices
DRSHLTR

SEQ ID NO: 5326 - protein, 7 aa, Artificial Sequence
  Description of Artificial Sequence: Synthetic peptide
  Zinc Finger Protein Recognition Helices
RSDDRKK

SEQ ID NO: 5327 - protein, 7 aa, Artificial Sequence
  Description of Artificial Sequence: Synthetic peptide
  Zinc Finger Protein Recognition Helices
ASKTRTN

SEQ ID NO: 5328 - protein, 7 aa, Artificial Sequence
  Description of Artificial Sequence: Synthetic peptide
  Zinc Finger Protein Recognition Helices
QSGSLTR

SEQ ID NO: 5329 - protein, 7 aa, Artificial Sequence
  Description of Artificial Sequence: Synthetic peptide
  Zinc Finger Protein Recognition Helices
LRHHLTR

SEQ ID NO: 5330 - protein, 7 aa, Artificial Sequence
  Description of Artificial Sequence: Synthetic peptide
  Zinc Finger Protein Recognition Helices
QSAHLKA

SEQ ID NO: 5331 - protein, 7 aa, Artificial Sequence
  Description of Artificial Sequence: Synthetic peptide
  Zinc Finger Protein Recognition Helices
QSGDLTR

SEQ ID NO: 5332 - protein, 7 aa, Artificial Sequence
  Description of Artificial Sequence: Synthetic peptide
  Zinc Finger Protein Recognition Helices
ASHNLRT

SEQ ID NO: 5333 - protein, 7 aa, Artificial Sequence
  Description of Artificial Sequence: Synthetic peptide
  Zinc Finger Protein Recognition Helices
DRSNLTR

SEQ ID NO: 5334 - protein, 7 aa, Artificial Sequence
  Description of Artificial Sequence: Synthetic peptide
  Zinc Finger Protein Recognition Helices
QSSDLSR

SEQ ID NO: 5335 - protein, 7 aa, Artificial Sequence
  Description of Artificial Sequence: Synthetic peptide
  Zinc Finger Protein Recognition Helices
DAGNRNK

SEQ ID NO: 5336 - protein, 7 aa, Artificial Sequence
  Description of Artificial Sequence: Synthetic peptide
  Zinc Finger Protein Recognition Helices
DRSDLSR

SEQ ID NO: 5337 - protein, 7 aa, Artificial Sequence
  Description of Artificial Sequence: Synthetic peptide
  Zinc Finger Protein Recognition Helices
RSDNLTR

SEQ ID NO: 5338 - protein, 7 aa, Artificial Sequence
  Description of Artificial Sequence: Synthetic peptide
  Zinc Finger Protein Recognition Helices
DRSHLSR

SEQ ID NO: 5339 - protein, 7 aa, Artificial Sequence
  Description of Artificial Sequence: Synthetic peptide
  Zinc Finger Protein Recognition Helices
TSGNLTR

SEQ ID NO: 5340 - protein, 7 aa, Artificial Sequence
  Description of Artificial Sequence: Synthetic peptide
  Zinc Finger Protein Recognition Helices
QSSDLSR

SEQ ID NO: 5341 - protein, 7 aa, Artificial Sequence
  Description of Artificial Sequence: Synthetic peptide
  Zinc Finger Protein Recognition Helices
QSSDLSR

SEQ ID NO: 5342 - protein, 7 aa, Artificial Sequence
  Description of Artificial Sequence: Synthetic peptide
  Zinc Finger Protein Recognition Helices
HRSTRNR

SEQ ID NO: 5343 - protein, 7 aa, Artificial Sequence
  Description of Artificial Sequence: Synthetic peptide
  Zinc Finger Protein Recognition Helices
RSDDLTR

SEQ ID NO: 5344 - protein, 7 aa, Artificial Sequence
  Description of Artificial Sequence: Synthetic peptide
  Zinc Finger Protein Recognition Helices
DRSNLKA

SEQ ID NO: 5345 - protein, 7 aa, Artificial Sequence
  Description of Artificial Sequence: Synthetic peptide
  Zinc Finger Protein Recognition Helices
DRSHLTR

SEQ ID NO: 5346 - protein, 7 aa, Artificial Sequence
  Description of Artificial Sequence: Synthetic peptide
  Zinc Finger Protein Recognition Helices
QRSTLKS

SEQ ID NO: 5347 - protein, 7 aa, Artificial Sequence
  Description of Artificial Sequence: Synthetic peptide
  Zinc Finger Protein Recognition Helices
RSDALSR

SEQ ID NO: 5348 - protein, 7 aa, Artificial Sequence
  Description of Artificial Sequence: Synthetic peptide
  Zinc Finger Protein Recognition Helices
RSDDLTR

SEQ ID NO: 5349 - protein, 7 aa, Artificial Sequence
  Description of Artificial Sequence: Synthetic peptide
  Zinc Finger Protein Recognition Helices
DRSHLTR

SEQ ID NO: 5350 - protein, 7 aa, Artificial Sequence
  Description of Artificial Sequence: Synthetic peptide
  Zinc Finger Protein Recognition Helices
TSSNRKT

SEQ ID NO: 5351 - protein, 7 aa, Artificial Sequence
  Description of Artificial Sequence: Synthetic peptide
  Zinc Finger Protein Recognition Helices
RSDTLSE

SEQ ID NO: 5352 - protein, 7 aa, Artificial Sequence
  Description of Artificial Sequence: Synthetic peptide
  Zinc Finger Protein Recognition Helices
DRSHLAR

SEQ ID NO: 5353 - protein, 7 aa, Artificial Sequence
  Description of Artificial Sequence: Synthetic peptide
  Zinc Finger Protein Recognition Helices
DRSARTR

SEQ ID NO: 5354 - protein, 7 aa, Artificial Sequence
  Description of Artificial Sequence: Synthetic peptide
  Zinc Finger Protein Recognition Helices
QSGHLSR

SEQ ID NO: 5355 - protein, 7 aa, Artificial Sequence
  Description of Artificial Sequence: Synthetic peptide
  Zinc Finger Protein Recognition Helices
QSGNLAR

SEQ ID NO: 5356 - protein, 7 aa, Artificial Sequence
  Description of Artificial Sequence: Synthetic peptide
  Zinc Finger Protein Recognition Helices
RSDVLST

SEQ ID NO: 5357 - protein, 7 aa, Artificial Sequence
  Description of Artificial Sequence: Synthetic peptide
  Zinc Finger Protein Recognition Helices
RYAYLTS

SEQ ID NO: 5358 - protein, 7 aa, Artificial Sequence
  Description of Artificial Sequence: Synthetic peptide
  Zinc Finger Protein Recognition Helices
RRWTLVG

SEQ ID NO: 5359 - protein, 7 aa, Artificial Sequence
  Description of Artificial Sequence: Synthetic peptide
  Zinc Finger Protein Recognition Helices
RSDNLSQ

SEQ ID NO: 5360 - protein, 7 aa, Artificial Sequence
  Description of Artificial Sequence: Synthetic peptide
  Zinc Finger Protein Recognition Helices
ASNDRKK

SEQ ID NO: 5361 - protein, 7 aa, Artificial Sequence
  Description of Artificial Sequence: Synthetic peptide
  Zinc Finger Protein Recognition Helices
QSGDLTR

SEQ ID NO: 5362 - protein, 7 aa, Artificial Sequence
  Description of Artificial Sequence: Synthetic peptide
  Zinc Finger Protein Recognition Helices
LKDTLRR

SEQ ID NO: 5363 - protein, 7 aa, Artificial Sequence
  Description of Artificial Sequence: Synthetic peptide
  Zinc Finger Protein Recognition Helices
QSGNLAR

SEQ ID NO: 5364 - protein, 7 aa, Artificial Sequence
  Description of Artificial Sequence: Synthetic peptide
  Zinc Finger Protein Recognition Helices
QSGDLTR

SEQ ID NO: 5365 - protein, 7 aa, Artificial Sequence
  Description of Artificial Sequence: Synthetic peptide
  Zinc Finger Protein Recognition Helices
MQNYLSR

SEQ ID NO: 5366 - protein, 7 aa, Artificial Sequence
  Description of Artificial Sequence: Synthetic peptide
  Zinc Finger Protein Recognition Helices
RSDHLSE

SEQ ID NO: 5367 - protein, 7 aa, Artificial Sequence
  Description of Artificial Sequence: Synthetic peptide
  Zinc Finger Protein Recognition Helices
QNANRKT

SEQ ID NO: 5368 - protein, 7 aa, Artificial Sequence
  Description of Artificial Sequence: Synthetic peptide
  Zinc Finger Protein Recognition Helices
RSADLTR

SEQ ID NO: 5369 - protein, 7 aa, Artificial Sequence
  Description of Artificial Sequence: Synthetic peptide
  Zinc Finger Protein Recognition Helices
RSDNLSE

SEQ ID NO: 5370 - protein, 7 aa, Artificial Sequence
  Description of Artificial Sequence: Synthetic peptide
  Zinc Finger Protein Recognition Helices
QSANRTK

SEQ ID NO: 5371 - protein, 7 aa, Artificial Sequence
  Description of Artificial Sequence: Synthetic peptide
  Zinc Finger Protein Recognition Helices
RSDALSR

SEQ ID NO: 5372 - protein, 7 aa, Artificial Sequence
  Description of Artificial Sequence: Synthetic peptide
  Zinc Finger Protein Recognition Helices
DRSALAR

SEQ ID NO: 5373 - protein, 7 aa, Artificial Sequence
  Description of Artificial Sequence: Synthetic peptide
  Zinc Finger Protein Recognition Helices
RSDHLSE

SEQ ID NO: 5374 - protein, 7 aa, Artificial Sequence
  Description of Artificial Sequence: Synthetic peptide
  Zinc Finger Protein Recognition Helices
DSQNRIK

SEQ ID NO: 5375 - protein, 7 aa, Artificial Sequence
  Description of Artificial Sequence: Synthetic peptide
  Zinc Finger Protein Recognition Helices
QSGDLTR

SEQ ID NO: 5376 - protein, 7 aa, Artificial Sequence
  Description of Artificial Sequence: Synthetic peptide
  Zinc Finger Protein Recognition Helices
DKGNLTK

SEQ ID NO: 5377 - protein, 7 aa, Artificial Sequence
  Description of Artificial Sequence: Synthetic peptide
  Zinc Finger Protein Recognition Helices
RSADLTR

SEQ ID NO: 5378 - protein, 7 aa, Artificial Sequence
  Description of Artificial Sequence: Synthetic peptide
  Zinc Finger Protein Recognition Helices
DRSHLAR

SEQ ID NO: 5379 - protein, 7 aa, Artificial Sequence
  Description of Artificial Sequence: Synthetic peptide
  Zinc Finger Protein Recognition Helices
RSDTLSE

SEQ ID NO: 5380 - protein, 7 aa, Artificial Sequence
  Description of Artificial Sequence: Synthetic peptide
  Zinc Finger Protein Recognition Helices
DRSNRKT

SEQ ID NO: 5381 - protein, 7 aa, Artificial Sequence
  Description of Artificial Sequence: Synthetic peptide
  Zinc Finger Protein Recognition Helices
DRSNLSR

SEQ ID NO: 5382 - protein, 7 aa, Artificial Sequence
  Description of Artificial Sequence: Synthetic peptide
  Zinc Finger Protein Recognition Helices
LRQDLKR

SEQ ID NO: 5383 - protein, 7 aa, Artificial Sequence
  Description of Artificial Sequence: Synthetic peptide
  Zinc Finger Protein Recognition Helices
RSDHLSE

SEQ ID NO: 5384 - protein, 7 aa, Artificial Sequence
  Description of Artificial Sequence: Synthetic peptide
  Zinc Finger Protein Recognition Helices
DRSALAR

SEQ ID NO: 5385 - protein, 7 aa, Artificial Sequence
  Description of Artificial Sequence: Synthetic peptide
  Zinc Finger Protein Recognition Helices
DRSALSR

SEQ ID NO: 5386 - protein, 7 aa, Artificial Sequence
  Description of Artificial Sequence: Synthetic peptide
  Zinc Finger Protein Recognition Helices
NRRGRWS

SEQ ID NO: 5387 - protein, 7 aa, Artificial Sequence
  Description of Artificial Sequence: Synthetic peptide
  Zinc Finger Protein Recognition Helices
RPYTLRL

SEQ ID NO: 5388 - protein, 7 aa, Artificial Sequence
  Description of Artificial Sequence: Synthetic peptide
  Zinc Finger Protein Recognition Helices
HRSSLRR

SEQ ID NO: 5389 - protein, 7 aa, Artificial Sequence
  Description of Artificial Sequence: Synthetic peptide
  Zinc Finger Protein Recognition Helices
RSDSLLR

SEQ ID NO: 5390 - protein, 7 aa, Artificial Sequence
  Description of Artificial Sequence: Synthetic peptide
  Zinc Finger Protein Recognition Helices
WLSSLSA

SEQ ID NO: 5391 - protein, 7 aa, Artificial Sequence
  Description of Artificial Sequence: Synthetic peptide
  Zinc Finger Protein Recognition Helices
QSGDLTR

SEQ ID NO: 5392 - protein, 7 aa, Artificial Sequence
  Description of Artificial Sequence: Synthetic peptide
  Zinc Finger Protein Recognition Helices
DRSHLAR

SEQ ID NO: 5393 - protein, 7 aa, Artificial Sequence
  Description of Artificial Sequence: Synthetic peptide
  Zinc Finger Protein Recognition Helices
DRSNLSR

SEQ ID NO: 5394 - protein, 7 aa, Artificial Sequence
  Description of Artificial Sequence: Synthetic peptide
  Zinc Finger Protein Recognition Helices
LKQHLNE

SEQ ID NO: 5395 - protein, 7 aa, Artificial Sequence
  Description of Artificial Sequence: Synthetic peptide
  Zinc Finger Protein Recognition Helices
LRHHLTR

SEQ ID NO: 5396 - protein, 7 aa, Artificial Sequence
  Description of Artificial Sequence: Synthetic peptide
  Zinc Finger Protein Recognition Helices
QSGNLHV

SEQ ID NO: 5397 - protein, 7 aa, Artificial Sequence
  Description of Artificial Sequence: Synthetic peptide
  Zinc Finger Protein Recognition Helices
TSGHLSR

SEQ ID NO: 5398 - DNA, 22 bp, Artificial Sequence
  Description of Artificial Sequence: Synthetic oligonucleotide
  Zinc Finger Binding Sequences
ctactccgtatgcgaaggcacg

SEQ ID NO: 5399 - DNA, 22 bp, Artificial Sequence
  Description of Artificial Sequence: Synthetic oligonucleotide
  Zinc Finger Binding Sequences
tattcgcggtgggacacttgat

SEQ ID NO: 5400 - DNA, 22 bp, Artificial Sequence
  Description of Artificial Sequence: Synthetic oligonucleotide
  Zinc Finger Binding Sequences
ccggagccggggcctcccaggc

SEQ ID NO: 5401 - DNA, 23 bp, Artificial Sequence
  Description of Artificial Sequence: Synthetic oligonucleotide
  Zinc Finger Binding Sequences
atcgcgacgcgacgcgacgagac

SEQ ID NO: 5402 - DNA, 13 bp, Artificial Sequence
  Description of Artificial Sequence: Synthetic oligonucleotide
  Zinc Finger Binding Sequences
tgcatgcgcagta

SEQ ID NO: 5403 - DNA, 18 bp, Artificial Sequence
  Description of Artificial Sequence: Synthetic oligonucleotide
  Zinc Finger Binding Sequences
acaccggcgcacggcacg

SEQ ID NO: 5404 - DNA, 12 bp, Artificial Sequence
  Description of Artificial Sequence: Synthetic oligonucleotide
  Zinc Finger Binding Sequences
agaggtgtaacc

SEQ ID NO: 5405 - DNA, 18 bp, Artificial Sequence
  Description of Artificial Sequence: Synthetic oligonucleotide
  Zinc Finger Binding Sequences
tcgggcacaagaaacgag

SEQ ID NO: 5406 - DNA, 15 bp, Artificial Sequence
  Description of Artificial Sequence: Synthetic oligonucleotide
  Zinc Finger Binding Sequences
tacgctgacaatgca

SEQ ID NO: 5407 - DNA, 18 bp, Artificial Sequence
  Description of Artificial Sequence: Synthetic oligonucleotide
  Zinc Finger Binding Sequences
ccagctgatggagaggac

SEQ ID NO: 5408 - DNA, 12 bp, Artificial Sequence
  Description of Artificial Sequence: Synthetic oligonucleotide
  Zinc Finger Binding Sequences
agagcaggcgag

SEQ ID NO: 5409 - DNA, 16 bp, Artificial Sequence
  Description of Artificial Sequence: Synthetic oligonucleotide
  Zinc Finger Binding Sequences
agcaaagtgagtagtt

SEQ ID NO: 5410 - DNA, 15 bp, Artificial Sequence
  Description of Artificial Sequence: Synthetic oligonucleotide
  Zinc Finger Binding Sequences
tggatggaaggaatc

SEQ ID NO: 5411 - DNA, 15 bp, Artificial Sequence
  Description of Artificial Sequence: Synthetic oligonucleotide
  Zinc Finger Binding Sequences
gaagctacatcccag

SEQ ID NO: 5412 - DNA, 18 bp, Artificial Sequence
  Description of Artificial Sequence: Synthetic oligonucleotide
  Zinc Finger Binding Sequences
tacgcgcaacggaacgca

SEQ ID NO: 5413 - DNA, 19 bp, Artificial Sequence
  Description of Artificial Sequence: Synthetic oligonucleotide
  Zinc Finger Binding Sequences
caccggtgtcgtgtaacag

SEQ ID NO: 5414 - DNA, 16 bp, Artificial Sequence
  Description of Artificial Sequence: Synthetic oligonucleotide
  Zinc Finger Binding Sequences
cccggacgacgccgag

SEQ ID NO: 5415 - DNA, 20 bp, Artificial Sequence
  Description of Artificial Sequence: Synthetic oligonucleotide
  Zinc Finger Binding Sequences
gacatggcacgcgcatcgag

SEQ ID NO: 5416 - DNA, 15 bp, Artificial Sequence
  Description of Artificial Sequence: Synthetic oligonucleotide
  Zinc Finger Binding Sequences
gcatgtgtggttttg

SEQ ID NO: 5417 - DNA, 15 bp, Artificial Sequence
  Description of Artificial Sequence: Synthetic oligonucleotide
  Zinc Finger Binding Sequences
ggtcaaggtagtgac

SEQ ID NO: 5418 - DNA, 2378 bp, Artificial Sequence
  Description of Artificial Sequence: Synthetic polynucleotide
  universal polynucleotide donor cassette sequence
aagttggtgatacatgaaccaacacgaagaacccgccagtcctactaccactctccttcgtttgacctagctggctggttaagaaactgatgttgataccagccactactccgagctagtagtaaaagatttttacagccaggggagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagctacgtgccttcgcatacggagtagtttattcgcggtgggacacttgatagaaaggttaagaggacacgcctaaacagttgtgaatacatacatacacaccgatacacagatgctaaagcactaaagcccctaaa

SEQ ID NO: 5419 - DNA, 2424 bp, Artificial Sequence
  Description of Artificial Sequence: Synthetic polynucleotide
  universal polynucleotide donor cassette sequence
tttgcgggatctggatgggctgttttcgcgcgcggcgtcactttcccttaacttctcgcgctggaagaggcagctgcctgcttttgcttggccgctgaccatgacacctggccccgctttgcagcccgtggaggactcttggcgagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcaggtggttgcctgggaggccccggctccgggcatcgcgacgcgacgcgacgagacgcgtaaaagtcacccgtcgcggtctcgcatgcgcgagggaggcaggcaggcagcgaacaaaatcgcacgcgcgtcgtcgactgcctggcctggcctggtccagctgaaaaccgccccggtttgcctccg

SEQ ID NO: 5420 - DNA, 2225 bp, Artificial Sequence
  Description of Artificial Sequence: Synthetic polynucleotide
  universal polynucleotide donor cassette sequence
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagtccgcagttaccttccccatcatgaacttggagaccgaaaggtgtggtgcctagttaccccgaagaaatgaaacatctgcattgtcagcgtagtatcccagctgatggagaggacatacccatgaggagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 5421 - DNA, 2234 bp, Artificial Sequence
  Description of Artificial Sequence: Synthetic polynucleotide
  universal polynucleotide donor cassette sequence
gagagctggggaagactatgcgcgatcgcctgcagtgtcgcgaggcagggagcagccgcgtgtccgcctgctgctgctggaatggcgcggtggccgcgcgcggtgacgtcggcaaggctggtctcgcctgctcttggcaagcaaagtgagtagttacacggcgctggctggagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5422 - DNA, 2165 bp, Artificial Sequence
  Description of Artificial Sequence: Synthetic polynucleotide
  universal polynucleotide donor cassette sequence
gagagctggggaagactatgcgcgatcgcctgcagtgttgtgcagccgtacgtgccgtgcgccggtgtatgtctgcatgcgcagtacttattttctgaagcgagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5423 - DNA, 2264 bp, Artificial Sequence
  Description of Artificial Sequence: Synthetic polynucleotide
  universal polynucleotide donor cassette sequence
gagagctggggaagactatgcgcgatcgcctgcagtaacgatttattttcctcgtttcttgtgcccgaaagagagaggtgtaacccatcctctataacagtgtggctttgacaacggttcaatatgtatgtttggcaaatgtagatttgtgccaattcttggtcataatcagcgcggacaaaccggctacccaaatttgggagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5424 - DNA, 2373 bp, Artificial Sequence
  Description of Artificial Sequence: Synthetic polynucleotide
  universal polynucleotide donor cassette sequence
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagataaggaactatatacaaaaccacacatgcacacgtggtcaaggtagtgactaatctcgcctaatacacggcgctggctgatgcatgcgtgacacggtggctagctagctgttgatcccggccggcccgtgatgacagcgctcggcgtcttcaggcttcagaaccgttgatcaaggacgatgagcttgagagctgaatccgcggttcgtggtgttcatctcagcgtgtctcgtcgtcggcccggtcggcagcggcagaatttcatttcagactggagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 5425 - DNA, 2241 bp, Artificial Sequence
  Description of Artificial Sequence: Synthetic polynucleotide
  universal polynucleotide donor cassette sequence
gagagctggggaagactatgcgcgatcgcctgcaggagcttgcattaactagcaaagtgattccttccatccatgcaagaagctacatcccagtgggtgcggcaaaagctgtatgaaaaggttggagacttccatacaactgttgtgtgtcgagtagtagaaaccaacaacaaagtcgagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5426 - DNA, 2195 bp, Artificial Sequence
  Description of Artificial Sequence: Synthetic polynucleotide
  universal polynucleotide donor cassette sequence
gagagctggggaagactatgcgcgatcgcctgcagggaccccgtcgccgtcggcacagcgtcagggcggtaacatgcgttccgttgcgcgtacggaccaccggtgtcgtgtaacaggaagagctgtcagtggagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5427 - DNA, 2222 bp, Artificial Sequence
  Description of Artificial Sequence: Synthetic polynucleotide
  universal polynucleotide donor cassette sequence
gagagctggggaagactatgcgcgatcgcctgcaggctcgtcgctgatcaccagtatctactcgtacagtactccatggatgcgtacgcgcccgggaactcctcggcgtcgtccgggctgaccgacatggcacgcgcatcgaggatgtagatgcacgtgagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgtta

SEQ ID NO: 5428 - DNA, 110 bp, Artificial Sequence
  Description of Artificial Sequence: Synthetic polynucleotide
  Analytical Domain
gagccacaggttagtagagtggtaggagcagtgttggactgatggctcgcttacataagcagttctgtcccatggagccaatgtcctgatacggtaggacacatatccct

SEQ ID NO: 5429 - DNA, 118 bp, Artificial Sequence
  Description of Artificial Sequence: Synthetic polynucleotide
  Analytical Domain
actagttttcatagggatatgtgaggactaaccttggccaaaggagctggaactgcctgcagttatgtaagggccttagtccaaattgctccaccctctgggaagctaatggactagt

SEQ ID NO: 5430 - DNA, 21 bp, Artificial Sequence
  Description of Artificial Sequence: Synthetic oligonucleotide
  Primer
cgccacaaatctgaaccagca

SEQ ID NO: 5431 - DNA, 24 bp, Artificial Sequence
  Description of Artificial Sequence: Synthetic oligonucleotide
  Primer
ccacgatcgacattgatctggcta

SEQ ID NO: 5432 - DNA, 21 bp, Artificial Sequence
  Description of Artificial Sequence: Synthetic oligonucleotide
  Primer
gcgacatatcaggccaacagg

SEQ ID NO: 5433 - DNA, 25 bp, Artificial Sequence
  Description of Artificial Sequence: Synthetic oligonucleotide
  Primer
gggatatgtgtcctaccgtatcagg

SEQ ID NO: 5434 - DNA, 21 bp, Artificial Sequence
  Description of Artificial Sequence: Synthetic oligonucleotide
  Primer
ccagcatacagttagggccca

SEQ ID NO: 5435 - DNA, 20 bp, Artificial Sequence
  Description of Artificial Sequence: Synthetic oligonucleotide
  Primer
gttgccttggtaggtccagc

SEQ ID NO: 5436 - DNA, 21 bp, Artificial Sequence
  Description of Artificial Sequence: Synthetic oligonucleotide
  Primer
cgaaaactcagcatgcgggaa

SEQ ID NO: 5437 - DNA, 21 bp, Artificial Sequence
  Description of Artificial Sequence: Synthetic oligonucleotide
  Primer
gagccatcagtccaacactgc

SEQ ID NO: 5438 - DNA, 20 bp, Artificial Sequence
  Description of Artificial Sequence: Synthetic oligonucleotide
  Primer
acaggcgtacagcaacacca

SEQ ID NO: 5439 - DNA, 22 bp, Artificial Sequence
  Description of Artificial Sequence: Synthetic oligonucleotide
  Primer
gaccctatggtgttggatccca

SEQ ID NO: 5440 - DNA, 21 bp, Artificial Sequence
  Description of Artificial Sequence: Synthetic oligonucleotide
  Primer
cgggagctaggcaacaaatcg

SEQ ID NO: 5441 - DNA, 23 bp, Artificial Sequence
  Description of Artificial Sequence: Synthetic oligonucleotide
  Primer
tctgactaaacgggtggatgctg

SEQ ID NO: 5442 - DNA, 26 bp, Artificial Sequence
  Description of Artificial Sequence: Synthetic oligonucleotide
  Primer
cggatcagttgattcgctcactttca

SEQ ID NO: 5443 - DNA, 21 bp, Artificial Sequence
  Description of Artificial Sequence: Synthetic oligonucleotide
  Primer
gccgaaaagcagcaactggaa

SEQ ID NO: 5444 - DNA, 21 bp, Artificial Sequence
  Description of Artificial Sequence: Synthetic oligonucleotide
  Primer
cactattcctccggcatgcag

SEQ ID NO: 5445 - DNA, 22 bp, Artificial Sequence
  Description of Artificial Sequence: Synthetic oligonucleotide
  Primer
tgacctattgatcggtcggctc

SEQ ID NO: 5446 - DNA, 22 bp, Artificial Sequence
  Description of Artificial Sequence: Synthetic oligonucleotide
  Primer
tgccttgaatctcagggatgca

SEQ ID NO: 5447 - DNA, 21 bp, Artificial Sequence
  Description of Artificial Sequence: Synthetic oligonucleotide
  Primer
gccgaagctaactagcggaca

SEQ ID NO: 5448 - DNA, 21 bp, Artificial Sequence
  Description of Artificial Sequence: Synthetic oligonucleotide
  Primer
catggagtagcagctgtgctg

SEQ ID NO: 5449 - DNA, 21 bp, Artificial Sequence
  Description of Artificial Sequence: Synthetic oligonucleotide
  Primer
gaaaagcagtcaccggctctg

SEQ ID NO: 5450 - DNA, 22 bp, Artificial Sequence
  Description of Artificial Sequence: Synthetic oligonucleotide
  Primer
ccatggacatgaattcggcacg

SEQ ID NO: 5451 - DNA, 21 bp, Artificial Sequence
  Description of Artificial Sequence: Synthetic oligonucleotide
  Primer
cttttgcaccacggagcagac

SEQ ID NO: 5452 - DNA, 25 bp, Artificial Sequence
  Description of Artificial Sequence: Synthetic oligonucleotide
  Primer
gctagcaaaactttgaagctcgctc

SEQ ID NO: 5453 - DNA, 21 bp, Artificial Sequence
  Description of Artificial Sequence: Synthetic oligonucleotide
  Primer
gaggtcccttacgggtcatcg

SEQ ID NO: 5454 - DNA, 22 bp, Artificial Sequence
  Description of Artificial Sequence: Synthetic oligonucleotide
  Primer
accaggtctatcttgcgcagac

SEQ ID NO: 5455 - DNA, 21 bp, Artificial Sequence
  Description of Artificial Sequence: Synthetic oligonucleotide
  Primer
aatagcgtggtcgggtcctag

SEQ ID NO: 5456 - DNA, 21 bp, Artificial Sequence
  Description of Artificial Sequence: Synthetic oligonucleotide
  Primer
acgaacgatccaaggtgcagt

SEQ ID NO: 5457 - DNA, 21 bp, Artificial Sequence
  Description of Artificial Sequence: Synthetic oligonucleotide
  Primer
tagagacgaggactctgggct

SEQ ID NO: 5458 - DNA, 21 bp, Artificial Sequence
  Description of Artificial Sequence: Synthetic oligonucleotide
  Primer
aagtccaacatgggcacaacc

SEQ ID NO: 5459 - DNA, 21 bp, Artificial Sequence
  Description of Artificial Sequence: Synthetic oligonucleotide
  Primer
cctcgttaagggtgcaggttg

SEQ ID NO: 5460 - DNA, 26 bp, Artificial Sequence
  Description of Artificial Sequence: Synthetic oligonucleotide
  Primer
ccaagtcagcttctaagccatcaaac

SEQ ID NO: 5461 - DNA, 22 bp, Artificial Sequence
  Description of Artificial Sequence: Synthetic oligonucleotide
  Primer
aaccctagacttctgcctggtg

SEQ ID NO: 5462 - DNA, 22 bp, Artificial Sequence
  Description of Artificial Sequence: Synthetic oligonucleotide
  Primer
gctcacttacgagcagatccca

SEQ ID NO: 5463 - DNA, 21 bp, Artificial Sequence
  Description of Artificial Sequence: Synthetic oligonucleotide
  Primer
ggtgcacgcatgttctcatgt

SEQ ID NO: 5464 - DNA, 21 bp, Artificial Sequence
  Description of Artificial Sequence: Synthetic oligonucleotide
  Primer
tgtttaccgcagccatgcttg

SEQ ID NO: 5465 - DNA, 23 bp, Artificial Sequence
  Description of Artificial Sequence: Synthetic oligonucleotide
  primer
gttgtatacggcatccatccgct

SEQ ID NO: 5466 - DNA, 23 bp, Artificial Sequence
  Description of Artificial Sequence: Synthetic oligonucleotide
  primer
gaatgaaactggtggtctgctcc

SEQ ID NO: 5467 - DNA, 22 bp, Artificial Sequence
  Description of Artificial Sequence: Synthetic oligonucleotide
  primer
ccgacgaggtacaagtagcagg

SEQ ID NO: 5468 - DNA, 23 bp, Artificial Sequence
  Description of Artificial Sequence: Synthetic oligonucleotide
  primer
cccgtagtccagattcttgtggt

SEQ ID NO: 5469 - DNA, 21 bp, Artificial Sequence
  Description of Artificial Sequence: Synthetic oligonucleotide
  primer
gtcgtttgttcggaaggggag

SEQ ID NO: 5470 - DNA, 21 bp, Artificial Sequence
  Description of Artificial Sequence: Synthetic oligonucleotide
  primer
cgtagttgtccggcatgtcct

SEQ ID NO: 5471 - DNA, 21 bp, Artificial Sequence
  Description of Artificial Sequence: Synthetic oligonucleotide
  primer sequence
tgtatcccttcggtgagcacg

SEQ ID NO: 5472 - DNA, 22 bp, Artificial Sequence
  Description of Artificial Sequence: Synthetic oligonucleotide
  primer
tgaatcgactcgctgacaggtg

SEQ ID NO: 5473 - DNA, 24 bp, Artificial Sequence
  Description of Artificial Sequence: Synthetic oligonucleotide
  primer
ccacgatcgacattgatctggcta

SEQ ID NO: 5474 - DNA, 25 bp, Artificial Sequence
  Description of Artificial Sequence: Synthetic oligonucleotide
  primer
gggatatgtgtcctaccgtatcagg

SEQ ID NO: 5475 - DNA, 20 bp, Artificial Sequence
  Description of Artificial Sequence: Synthetic oligonucleotide
  primer
gttgccttggtaggtccagc

SEQ ID NO: 5476 - DNA, 21 bp, Artificial Sequence
  Description of Artificial Sequence: Synthetic oligonucleotide
  primer
gagccatcagtccaacactgc

SEQ ID NO: 5477 - DNA, 20 bp, Artificial Sequence
  Description of Artificial Sequence: Synthetic oligonucleotide
  primer
tggcactaatctcaccggct

SEQ ID NO: 5478 - DNA, 22 bp, Artificial Sequence
  Description of Artificial Sequence: Synthetic oligonucleotide
  primer
agtcttagaagtacgctaccgt

SEQ ID NO: 5479 - DNA, 19 bp, Artificial Sequence
  Description of Artificial Sequence: Synthetic oligonucleotide
  primer
tacttggcttcggcggcga

SEQ ID NO: 5480 - DNA, 21 bp, Artificial Sequence
  Description of Artificial Sequence: Synthetic oligonucleotide
  primer
gggtgacttttacgcgtctcg

SEQ ID NO: 5481 - DNA, 20 bp, Artificial Sequence
  Description of Artificial Sequence: Synthetic oligonucleotide
  primer
ggtcacgacgcatggcctaa

SEQ ID NO: 5482 - DNA, 20 bp, Artificial Sequence
  Description of Artificial Sequence: Synthetic oligonucleotide
  primer
aggatgcatggatcaccgtc

SEQ ID NO: 5483 - DNA, 20 bp, Artificial Sequence
  Description of Artificial Sequence: Synthetic oligonucleotide
  Primer
gctctgttgtgcagccgtac

SEQ ID NO: 5484 - DNA, 22 bp, Artificial Sequence
  Description of Artificial Sequence: Synthetic oligonucleotide
  Primer
cgttgcagataccacagtgtac

SEQ ID NO: 5485 - DNA, 25 bp, Artificial Sequence
  Description of Artificial Sequence: Synthetic oligonucleotide
  Primer
gctagtagctgtttacacggcgtct

SEQ ID NO: 5486 - DNA, 22 bp, Artificial Sequence
  Description of Artificial Sequence: Synthetic oligonucleotide
  Primer
aggtcgagacaaccaagtagag

SEQ ID NO: 5487 - DNA, 20 bp, Artificial Sequence
  Description of Artificial Sequence: Synthetic oligonucleotide
  Primer
acaggacatcgagcttgcat

SEQ ID NO: 5488 - DNA, 23 bp, Artificial Sequence
  Description of Artificial Sequence: Synthetic oligonucleotide
  Primer
cagaagaaaggcatcaactcatg

SEQ ID NO: 5489 - DNA, 26 bp, Artificial Sequence
  Description of Artificial Sequence: Synthetic oligonucleotide
  Primer
ctctttcacctctacttttacttcag

SEQ ID NO: 5490 - DNA, 21 bp, Artificial Sequence
  Description of Artificial Sequence: Synthetic oligonucleotide
  Primer
attgaaccgttgtcaaagcca

SEQ ID NO: 5491 - DNA, 20 bp, Artificial Sequence
  Description of Artificial Sequence: Synthetic oligonucleotide
  Primer
cacagcgtcagggcggtaac

SEQ ID NO: 5492 - DNA, 20 bp, Artificial Sequence
  Description of Artificial Sequence: Synthetic oligonucleotide
  Primer
ggcacgcacctgtcactgac

SEQ ID NO: 5493 - DNA, 20 bp, Artificial Sequence
  Description of Artificial Sequence: Synthetic oligonucleotide
  Primer
gtacgcgcccgggaactcct

SEQ ID NO: 5494 - DNA, 20 bp, Artificial Sequence
  Description of Artificial Sequence: Synthetic oligonucleotide
  Primer
cctgcggcccacgtgcatct

SEQ ID NO: 5495 - protein, 7 aa, Artificial Sequence
  Description of Artificial Sequence: Synthetic peptide
  Zinc Finger Protein Recognition Helices
QSSDLSR

SEQ ID NO: 5496 - protein, 7 aa, Artificial Sequence
  Description of Artificial Sequence: Synthetic peptide
  Zinc Finger Protein Recognition Helices
QSGNLAR

SEQ ID NO: 5497 - protein, 7 aa, Artificial Sequence
  Description of Artificial Sequence: Synthetic peptide
  Zinc Finger Protein Recognition Helices
DRSNRTT

SEQ ID NO: 5498 - protein, 7 aa, Artificial Sequence
  Description of Artificial Sequence: Synthetic peptide
  Zinc Finger Protein Recognition Helices
DNSNRIK

SEQ ID NO: 5499 - protein, 7 aa, Artificial Sequence
  Description of Artificial Sequence: Synthetic peptide
  Zinc Finger Protein Recognition Helices
QSSDLSR

SEQ ID NO: 5500 - protein, 7 aa, Artificial Sequence
  Description of Artificial Sequence: Synthetic peptide
  Zinc Finger Protein Recognition Helices
RTDALRG

SEQ ID NO: 5501 - protein, 7 aa, Artificial Sequence
  Description of Artificial Sequence: Synthetic peptide
  Zinc Finger Protein Recognition Helices
RSDHLSE

SEQ ID NO: 5502 - protein, 7 aa, Artificial Sequence
  Description of Artificial Sequence: Synthetic peptide
  Zinc Finger Protein Recognition Helices
SYRSRWG

SEQ ID NO: 5503 - protein, 7 aa, Artificial Sequence
  Description of Artificial Sequence: Synthetic peptide
  Zinc Finger Binding Motifs Domain
DRSALAR

SEQ ID NO: 5504 - protein, 7 aa, Artificial Sequence
  Description of Artificial Sequence: Synthetic peptide
  Zinc Finger Protein Recognition Helices
RSDTLSE

SEQ ID NO: 5505 - protein, 7 aa, Artificial Sequence
  Description of Artificial Sequence: Synthetic peptide
  Zinc Finger Protein Recognition Helices
QSGDLTR

SEQ ID NO: 5506 - protein, 7 aa, Artificial Sequence
  Description of Artificial Sequence: Synthetic peptide
  Zinc Finger Protein Recognition Helices
TSGNLTR

SEQ ID NO: 5507 - protein, 7 aa, Artificial Sequence
  Description of Artificial Sequence: Synthetic peptide
  Zinc Finger Protein Recognition Helices
DRSALAR

SEQ ID NO: 5508 - protein, 7 aa, Artificial Sequence
  Description of Artificial Sequence: Synthetic peptide
  Zinc Finger Protein Recognition Helices
RSDSLSV

SEQ ID NO: 5509 - protein, 7 aa, Artificial Sequence
  Description of Artificial Sequence: Synthetic peptide
  Zinc Finger Protein Recognition Helices
QSGDLTR

SEQ ID NO: 5510 - protein, 7 aa, Artificial Sequence
  Description of Artificial Sequence: Synthetic peptide
  Zinc Finger Protein Recognition Helices
DRSNLSR

SEQ ID NO: 5511 - protein, 7 aa, Artificial Sequence
  Description of Artificial Sequence: Synthetic peptide
  Zinc Finger Protein Recognition Helices
RQDSRSQ

SEQ ID NO: 5512 - protein, 7 aa, Artificial Sequence
  Description of Artificial Sequence: Synthetic peptide
  Zinc Finger Protein Recognition Helices
RSDHLSA

SEQ ID NO: 5513 - protein, 7 aa, Artificial Sequence
  Description of Artificial Sequence: Synthetic peptide
  Zinc Finger Protein Recognition Helices
QHGSLAS

SEQ ID NO: 5514 - protein, 7 aa, Artificial Sequence
  Description of Artificial Sequence: Synthetic peptide
  Zinc Finger Protein Recognition Helices
RSANLAR

SEQ ID NO: 5515 - protein, 7 aa, Artificial Sequence
  Description of Artificial Sequence: Synthetic peptide
  Zinc Finger Protein Recognition Helices
RSDHLTT

SEQ ID NO: 5516 - protein, 7 aa, Artificial Sequence
  Description of Artificial Sequence: Synthetic peptide
  Zinc Finger Protein Recognition Helices
RSANLAR

SEQ ID NO: 5517 - protein, 7 aa, Artificial Sequence
  Description of Artificial Sequence: Synthetic peptide
  Zinc Finger Protein Recognition Helices
TNQNRIT

SEQ ID NO: 5518 - protein, 7 aa, Artificial Sequence
  Description of Artificial Sequence: Synthetic peptide
  Zinc Finger Protein Recognition Helices
QSGNLAR

SEQ ID NO: 5519 - protein, 7 aa, Artificial Sequence
  Description of Artificial Sequence: Synthetic peptide
  Zinc Finger Protein Recognition Helices
QSNQLAV

SEQ ID NO: 5520 - protein, 7 aa, Artificial Sequence
  Description of Artificial Sequence: Synthetic peptide
  Zinc Finger Protein Recognition Helices
QNAHRKT

SEQ ID NO: 5521 - protein, 7 aa, Artificial Sequence
  Description of Artificial Sequence: Synthetic peptide
  Zinc Finger Protein Recognition Helices
RSDDLSK

SEQ ID NO: 5522 - protein, 7 aa, Artificial Sequence
  Description of Artificial Sequence: Synthetic peptide
  Zinc Finger Protein Recognition Helices
RSDTRKT

SEQ ID NO: 5523 - protein, 7 aa, Artificial Sequence
  Description of Artificial Sequence: Synthetic peptide
  Zinc Finger Protein Recognition Helices
QSSHLTR

SEQ ID NO: 5524 - protein, 7 aa, Artificial Sequence
  Description of Artificial Sequence: Synthetic peptide
  Zinc Finger Protein Recognition Helices
QSSDLTR

SEQ ID NO: 5525 - protein, 7 aa, Artificial Sequence
  Description of Artificial Sequence: Synthetic peptide
  Zinc Finger Protein Recognition Helices
RSDDLTR

SEQ ID NO: 5526 - protein, 7 aa, Artificial Sequence
  Description of Artificial Sequence: Synthetic peptide
  Zinc Finger Protein Recognition Helices
QSSDLRR

SEQ ID NO: 5527 - protein, 7 aa, Artificial Sequence
  Description of Artificial Sequence: Synthetic peptide
  Zinc Finger Protein Recognition Helices
TSGSLSR

SEQ ID NO: 5528 - protein, 7 aa, Artificial Sequence
  Description of Artificial Sequence: Synthetic peptide
  Zinc Finger Protein Recognition Helices
TSSNRAV

SEQ ID NO: 5529 - protein, 7 aa, Artificial Sequence
  Description of Artificial Sequence: Synthetic peptide
  Zinc Finger Protein Recognition Helices
RSDHLSR

SEQ ID NO: 5530 - protein, 7 aa, Artificial Sequence
  Description of Artificial Sequence: Synthetic peptide
  Zinc Finger Protein Recognition Helices
DRSARNS

SEQ ID NO: 5531 - protein, 7 aa, Artificial Sequence
  Description of Artificial Sequence: Synthetic peptide
  Zinc Finger Protein Recognition Helices
RSDTLSE

SEQ ID NO: 5532 - protein, 7 aa, Artificial Sequence
  Description of Artificial Sequence: Synthetic peptide
  Zinc Finger Protein Recognition Helices
SRCWRRK

SEQ ID NO: 5533 - protein, 7 aa, Artificial Sequence
  Description of Artificial Sequence: Synthetic peptide
  Zinc Finger Protein Recognition Helices
TSGNLTR

SEQ ID NO: 5534 - protein, 7 aa, Artificial Sequence
  Description of Artificial Sequence: Synthetic peptide
  Zinc Finger Protein Recognition Helices
LKQMLAV

SEQ ID NO: 5535 - protein, 7 aa, Artificial Sequence
  Description of Artificial Sequence: Synthetic peptide
  Zinc Finger Protein Recognition Helices
QSSNLAR

SEQ ID NO: 5536 - protein, 7 aa, Artificial Sequence
  Description of Artificial Sequence: Synthetic peptide
  Zinc Finger Protein Recognition Helices
RSDNLTR

SEQ ID NO: 5537 - protein, 7 aa, Artificial Sequence
  Description of Artificial Sequence: Synthetic peptide
  Zinc Finger Protein Recognition Helices
RSDNLST

SEQ ID NO: 5538 - protein, 7 aa, Artificial Sequence
  Description of Artificial Sequence: Synthetic peptide
  Zinc Finger Protein Recognition Helices
QSGHLSR

SEQ ID NO: 5539 - protein, 7 aa, Artificial Sequence
  Description of Artificial Sequence: Synthetic peptide
  Zinc Finger Protein Recognition Helices
RSDNLAR

SEQ ID NO: 5540 - protein, 7 aa, Artificial Sequence
  Description of Artificial Sequence: Synthetic peptide
  Zinc Finger Protein Recognition Helices
QKKDRSY

SEQ ID NO: 5541 - protein, 7 aa, Artificial Sequence
  Description of Artificial Sequence: Synthetic peptide
  Zinc Finger Protein Recognition Helices
RSDVLSR

SEQ ID NO: 5542 - protein, 7 aa, Artificial Sequence
  Description of Artificial Sequence: Synthetic peptide
  Zinc Finger Protein Recognition Helices
DSRDRKN

SEQ ID NO: 5543 - protein, 7 aa, Artificial Sequence
  Description of Artificial Sequence: Synthetic peptide
  Zinc Finger Protein Recognition Helices
RSAHLSR

SEQ ID NO: 5544 - protein, 7 aa, Artificial Sequence
  Description of Artificial Sequence: Synthetic peptide
  Zinc Finger Protein Recognition Helices
QSANRTK

SEQ ID NO: 5545 - protein, 7 aa, Artificial Sequence
  Description of Artificial Sequence: Synthetic peptide
  Zinc Finger Protein Recognition Helices
QSSDLSR

SEQ ID NO: 5546 - protein, 7 aa, Artificial Sequence
  Description of Artificial Sequence: Synthetic peptide
  Zinc Finger Protein Recognition Helices
QSSDLSR

SEQ ID NO: 5547 - protein, 7 aa, Artificial Sequence
  Description of Artificial Sequence: Synthetic peptide
  Zinc Finger Protein Recognition Helices
QWSTRKR

SEQ ID NO: 5548 - protein, 7 aa, Artificial Sequence
  Description of Artificial Sequence: Synthetic peptide
  Zinc Finger Protein Recognition Helices
QSSDLSR

SEQ ID NO: 5549 - protein, 7 aa, Artificial Sequence
  Description of Artificial Sequence: Synthetic peptide
  Zinc Finger Protein Recognition Helices
QSAHRKN

SEQ ID NO: 5550 - protein, 7 aa, Artificial Sequence
  Description of Artificial Sequence: Synthetic peptide
  Zinc Finger Protein Recognition Helices
RSDNLST

SEQ ID NO: 5551 - protein, 7 aa, Artificial Sequence
  Description of Artificial Sequence: Synthetic peptide
  Zinc Finger Protein Recognition Helices
DSSTRKT

SEQ ID NO: 5552 - protein, 7 aa, Artificial Sequence
  Description of Artificial Sequence: Synthetic peptide
  Zinc Finger Protein Recognition Helices
RSDHLSR

SEQ ID NO: 5553 - protein, 7 aa, Artificial Sequence
  Description of Artificial Sequence: Synthetic peptide
  Zinc Finger Protein Recognition Helices
DRSNRKT

SEQ ID NO: 5554 - protein, 7 aa, Artificial Sequence
  Description of Artificial Sequence: Synthetic peptide
  Zinc Finger Protein Recognition Helices
QSSDLSR

SEQ ID NO: 5555 - protein, 7 aa, Artificial Sequence
  Description of Artificial Sequence: Synthetic peptide
  Zinc Finger Protein Recognition Helices
QAGNLSK

SEQ ID NO: 5556 - protein, 7 aa, Artificial Sequence
  Description of Artificial Sequence: Synthetic peptide
  Zinc Finger Protein Recognition Helices
DRSNLSR

SEQ ID NO: 5557 - protein, 7 aa, Artificial Sequence
  Description of Artificial Sequence: Synthetic peptide
  Zinc Finger Protein Recognition Helices
LKQHLTR

SEQ ID NO: 5558 - protein, 7 aa, Artificial Sequence
  Description of Artificial Sequence: Synthetic peptide
  Zinc Finger Protein Recognition Helices
DRSNLSR

SEQ ID NO: 5559 - protein, 7 aa, Artificial Sequence
  Description of Artificial Sequence: Synthetic peptide
  Zinc Finger Protein Recognition Helices
QSGDLTR

SEQ ID NO: 5560 - protein, 7 aa, Artificial Sequence
  Description of Artificial Sequence: Synthetic peptide
  Zinc Finger Protein Recognition Helices
QSSDLSR

SEQ ID NO: 5561 - protein, 7 aa, Artificial Sequence
  Description of Artificial Sequence: Synthetic peptide
  Zinc Finger Protein Recognition Helices
QAGNLSK

SEQ ID NO: 5562 - protein, 7 aa, Artificial Sequence
  Description of Artificial Sequence: Synthetic peptide
  Zinc Finger Protein Recognition Helices
QNAHRKT

SEQ ID NO: 5563 - protein, 7 aa, Artificial Sequence
  Description of Artificial Sequence: Synthetic peptide
  Zinc Finger Protein Recognition Helices
RSDHLSQ

SEQ ID NO: 5564 - protein, 7 aa, Artificial Sequence
  Description of Artificial Sequence: Synthetic peptide
  Zinc Finger Protein Recognition Helices
QNAHRIT

SEQ ID NO: 5565 - protein, 7 aa, Artificial Sequence
  Description of Artificial Sequence: Synthetic peptide
  Zinc Finger Protein Recognition Helices
RSDDLTR

SEQ ID NO: 5566 - protein, 7 aa, Artificial Sequence
  Description of Artificial Sequence: Synthetic peptide
  Zinc Finger Protein Recognition Helices
QRSTLSS

SEQ ID NO: 5567 - protein, 7 aa, Artificial Sequence
  Description of Artificial Sequence: Synthetic peptide
  Zinc Finger Protein Recognition Helices
TSGNLTR

SEQ ID NO: 5568 - protein, 7 aa, Artificial Sequence
  Description of Artificial Sequence: Synthetic peptide
  Zinc Finger Protein Recognition Helices
DRSNLTR

SEQ ID NO: 5569 - protein, 7 aa, Artificial Sequence
  Description of Artificial Sequence: Synthetic peptide
  Zinc Finger Protein Recognition Helices
TSGNLTR

SEQ ID NO: 5570 - protein, 7 aa, Artificial Sequence
  Description of Artificial Sequence: Synthetic peptide
  Zinc Finger Protein Recognition Helices
RSDDLTR

SEQ ID NO: 5571 - protein, 7 aa, Artificial Sequence
  Description of Artificial Sequence: Synthetic peptide
  Zinc Finger Protein Recognition Helices
QSGDLTR

SEQ ID NO: 5572 - protein, 7 aa, Artificial Sequence
  Description of Artificial Sequence: Synthetic peptide
  Zinc Finger Protein Recognition Helices
MQNYLSR

SEQ ID NO: 5573 - protein, 7 aa, Artificial Sequence
  Description of Artificial Sequence: Synthetic peptide
  Zinc Finger Protein Recognition Helices
QSGNLAR

SEQ ID NO: 5574 - protein, 7 aa, Artificial Sequence
  Description of Artificial Sequence: Synthetic peptide
  Zinc Finger Protein Recognition Helices
DQSGLAH

SEQ ID NO: 5575 - protein, 7 aa, Artificial Sequence
  Description of Artificial Sequence: Synthetic peptide
  Zinc Finger Protein Recognition Helices
RSDNLST

SEQ ID NO: 5576 - protein, 7 aa, Artificial Sequence
  Description of Artificial Sequence: Synthetic peptide
  Zinc Finger Protein Recognition Helices
DRSALAR

SEQ ID NO: 5577 - protein, 7 aa, Artificial Sequence
  Description of Artificial Sequence: Synthetic peptide
  Zinc Finger Protein Recognition Helices
LKQHLTR

SEQ ID NO: 5578 - protein, 7 aa, Artificial Sequence
  Description of Artificial Sequence: Synthetic peptide
  Zinc Finger Protein Recognition Helices
RRDDLRN

SEQ ID NO: 5579 - protein, 7 aa, Artificial Sequence
  Description of Artificial Sequence: Synthetic peptide
  Zinc Finger Protein Recognition Helices
RSDDLTR

SEQ ID NO: 5580 - protein, 7 aa, Artificial Sequence
  Description of Artificial Sequence: Synthetic peptide
  Zinc Finger Protein Recognition Helices
DRSNLKA

SEQ ID NO: 5581 - protein, 7 aa, Artificial Sequence
  Description of Artificial Sequence: Synthetic peptide
  Zinc Finger Protein Recognition Helices
RSDTLSE

SEQ ID NO: 5582 - protein, 7 aa, Artificial Sequence
  Description of Artificial Sequence: Synthetic peptide
  Zinc Finger Protein Recognition Helices
QSGDLTR

SEQ ID NO: 5583 - protein, 7 aa, Artificial Sequence
  Description of Artificial Sequence: Synthetic peptide
  Zinc Finger Protein Recognition Helices
QSGDLTR

SEQ ID NO: 5584 - protein, 7 aa, Artificial Sequence
  Description of Artificial Sequence: Synthetic peptide
  Zinc Finger Protein Recognition Helices
DRSVLRR

SEQ ID NO: 5585 - protein, 7 aa, Artificial Sequence
  Description of Artificial Sequence: Synthetic peptide
  Zinc Finger Protein Recognition Helices
RSDNLAR

SEQ ID NO: 5586 - protein, 7 aa, Artificial Sequence
  Description of Artificial Sequence: Synthetic peptide
  Zinc Finger Protein Recognition Helices
DRSNLTR

SEQ ID NO: 5587 - protein, 7 aa, Artificial Sequence
  Description of Artificial Sequence: Synthetic peptide
  Zinc Finger Protein Recognition Helices
DRSHLTR

SEQ ID NO: 5588 - protein, 7 aa, Artificial Sequence
  Description of Artificial Sequence: Synthetic peptide
  Zinc Finger Protein Recognition Helices
QSGDLTR

SEQ ID NO: 5589 - protein, 7 aa, Artificial Sequence
  Description of Artificial Sequence: Synthetic peptide
  Zinc Finger Protein Recognition Helices
QSGDLTR

SEQ ID NO: 5590 - protein, 7 aa, Artificial Sequence
  Description of Artificial Sequence: Synthetic peptide
  Zinc Finger Protein Recognition Helices
RSDNLSE

SEQ ID NO: 5591 - protein, 7 aa, Artificial Sequence
  Description of Artificial Sequence: Synthetic peptide
  Zinc Finger Protein Recognition Helices
KRGNRAK

SEQ ID NO: 5592 - protein, 7 aa, Artificial Sequence
  Description of Artificial Sequence: Synthetic peptide
  Zinc Finger Protein Recognition Helices
ERGTLAR

SEQ ID NO: 5593 - protein, 7 aa, Artificial Sequence
  Description of Artificial Sequence: Synthetic peptide
  Zinc Finger Protein Recognition Helices
RSDALAR

SEQ ID NO: 5594 - protein, 7 aa, Artificial Sequence
  Description of Artificial Sequence: Synthetic peptide
  Zinc Finger Protein Recognition Helices
RSDALSR

SEQ ID NO: 5595 - protein, 7 aa, Artificial Sequence
  Description of Artificial Sequence: Synthetic peptide
  Zinc Finger Protein Recognition Helices
DRSALAR

SEQ ID NO: 5596 - protein, 7 aa, Artificial Sequence
  Description of Artificial Sequence: Synthetic peptide
  Zinc Finger Protein Recognition Helices
ERGTLAR

SEQ ID NO: 5597 - protein, 7 aa, Artificial Sequence
  Description of Artificial Sequence: Synthetic peptide
  Zinc Finger Protein Recognition Helices
DRSALAR

SEQ ID NO: 5598 - protein, 7 aa, Artificial Sequence
  Description of Artificial Sequence: Synthetic peptide
  Zinc Finger Protein Recognition Helices
QSSDLSR

SEQ ID NO: 5599 - protein, 7 aa, Artificial Sequence
  Description of Artificial Sequence: Synthetic peptide
  Zinc Finger Protein Recognition Helices
RSDHLSR

SEQ ID NO: 5600 - protein, 7 aa, Artificial Sequence
  Description of Artificial Sequence: Synthetic peptide
  Zinc Finger Protein Recognition Helices
RSDTLSQ

SEQ ID NO: 5601 - protein, 7 aa, Artificial Sequence
  Description of Artificial Sequence: Synthetic peptide
  Zinc Finger Protein Recognition Helices
QKATRIT

SEQ ID NO: 5602 - protein, 7 aa, Artificial Sequence
  Description of Artificial Sequence: Synthetic peptide
  Zinc Finger Protein Recognition Helices
RSDALAR

SEQ ID NO: 5603 - protein, 7 aa, Artificial Sequence
  Description of Artificial Sequence: Synthetic peptide
  Zinc Finger Protein Recognition Helices
RSDNLSV

SEQ ID NO: 5604 - protein, 7 aa, Artificial Sequence
  Description of Artificial Sequence: Synthetic peptide
  Zinc Finger Protein Recognition Helices
DRSHLAR

SEQ ID NO: 5605 - protein, 7 aa, Artificial Sequence
  Description of Artificial Sequence: Synthetic peptide
  Zinc Finger Protein Recognition Helices
RSDTLSR

SEQ ID NO: 5606 - protein, 7 aa, Artificial Sequence
  Description of Artificial Sequence: Synthetic peptide
  Zinc Finger Protein Recognition Helices
QSADRTK

SEQ ID NO: 5607 - protein, 7 aa, Artificial Sequence
  Description of Artificial Sequence: Synthetic peptide
  Zinc Finger Protein Recognition Helices
TSGHLSR

SEQ ID NO: 5608 - protein, 7 aa, Artificial Sequence
  Description of Artificial Sequence: Synthetic peptide
  Zinc Finger Protein Recognition Helices
QRSNLVR

SEQ ID NO: 5609 - protein, 7 aa, Artificial Sequence
  Description of Artificial Sequence: Synthetic peptide
  Zinc Finger Protein Recognition Helices
DRSHLAR

SEQ ID NO: 5610 - protein, 7 aa, Artificial Sequence
  Description of Artificial Sequence: Synthetic peptide
  Zinc Finger Protein Recognition Helices
RSDTLSE

SEQ ID NO: 5611 - protein, 7 aa, Artificial Sequence
  Description of Artificial Sequence: Synthetic peptide
  Zinc Finger Protein Recognition Helices
RMYTLSK

SEQ ID NO: 5612 - protein, 7 aa, Artificial Sequence
  Description of Artificial Sequence: Synthetic peptide
  Zinc Finger Protein Recognition Helices
DRSALSR

SEQ ID NO: 5613 - protein, 7 aa, Artificial Sequence
  Description of Artificial Sequence: Synthetic peptide
  Zinc Finger Protein Recognition Helices
RSDDLTR

SEQ ID NO: 5614 - protein, 7 aa, Artificial Sequence
  Description of Artificial Sequence: Synthetic peptide
  Zinc Finger Protein Recognition Helices
RSDALTQ

SEQ ID NO: 5615 - protein, 7 aa, Artificial Sequence
  Description of Artificial Sequence: Synthetic peptide
  Zinc Finger Protein Recognition Helices
DRSDLSR

SEQ ID NO: 5616 - protein, 7 aa, Artificial Sequence
  Description of Artificial Sequence: Synthetic peptide
  Zinc Finger Protein Recognition Helices
RRTDLRR

SEQ ID NO: 5617 - protein, 7 aa, Artificial Sequence
  Description of Artificial Sequence: Synthetic peptide
  Zinc Finger Protein Recognition Helices
RSDNLAR

SEQ ID NO: 5618 - protein, 7 aa, Artificial Sequence
  Description of Artificial Sequence: Synthetic peptide
  Zinc Finger Protein Recognition Helices
QRSPLPA

SEQ ID NO: 5619 - protein, 7 aa, Artificial Sequence
  Description of Artificial Sequence: Synthetic peptide
  Zinc Finger Protein Recognition Helices
RSDSLSA

SEQ ID NO: 5620 - protein, 7 aa, Artificial Sequence
  Description of Artificial Sequence: Synthetic peptide
  Zinc Finger Protein Recognition Helices
QNAHRKT

SEQ ID NO: 5621 - protein, 7 aa, Artificial Sequence
  Description of Artificial Sequence: Synthetic peptide
  Zinc Finger Protein Recognition Helices
ERGTLAR

SEQ ID NO: 5622 - protein, 7 aa, Artificial Sequence
  Description of Artificial Sequence: Synthetic peptide
  Zinc Finger Protein Recognition Helices
RSDNLTR

SEQ ID NO: 5623 - protein, 7 aa, Artificial Sequence
  Description of Artificial Sequence: Synthetic peptide
  Zinc Finger Protein Recognition Helices
TSGNLTR

SEQ ID NO: 5624 - protein, 7 aa, Artificial Sequence
  Description of Artificial Sequence: Synthetic peptide
  Zinc Finger Protein Recognition Helices
QRSHLSD

SEQ ID NO: 5625 - protein, 7 aa, Artificial Sequence
  Description of Artificial Sequence: Synthetic peptide
  Zinc Finger Protein Recognition Helices
QSGDLTR

SEQ ID NO: 5626 - protein, 7 aa, Artificial Sequence
  Description of Artificial Sequence: Synthetic peptide
  Zinc Finger Protein Recognition Helices
QRSNLNI

SEQ ID NO: 5627 - protein, 7 aa, Artificial Sequence
  Description of Artificial Sequence: Synthetic peptide
  Zinc Finger Protein Recognition Helices
RSDNLAR

SEQ ID NO: 5628 - protein, 7 aa, Artificial Sequence
  Description of Artificial Sequence: Synthetic peptide
  Zinc Finger Protein Recognition Helices
DRSVLHR

SEQ ID NO: 5629 - protein, 7 aa, Artificial Sequence
  Description of Artificial Sequence: Synthetic peptide
  Zinc Finger Protein Recognition Helices
DRSDLSR

SEQ ID NO: 5630 - protein, 7 aa, Artificial Sequence
  Description of Artificial Sequence: Synthetic peptide
  Zinc Finger Protein Recognition Helices
RQDTLRS

SEQ ID NO: 5631 - protein, 7 aa, Artificial Sequence
  Description of Artificial Sequence: Synthetic peptide
  Zinc Finger Protein Recognition Helices
RSDALSR

SEQ ID NO: 5632 - protein, 7 aa, Artificial Sequence
  Description of Artificial Sequence: Synthetic peptide
  Zinc Finger Protein Recognition Helices
QSGSLTR

SEQ ID NO: 5633 - protein, 7 aa, Artificial Sequence
  Description of Artificial Sequence: Synthetic peptide
  Zinc Finger Protein Recognition Helices
RSDALSV

SEQ ID NO: 5634 - protein, 7 aa, Artificial Sequence
  Description of Artificial Sequence: Synthetic peptide
  Zinc Finger Protein Recognition Helices
DSSHRTR

SEQ ID NO: 5635 - protein, 7 aa, Artificial Sequence
  Description of Artificial Sequence: Synthetic peptide
  Zinc Finger Protein Recognition Helices
QSGDLTR

SEQ ID NO: 5636 - protein, 7 aa, Artificial Sequence
  Description of Artificial Sequence: Synthetic peptide
  Zinc Finger Protein Recognition Helices
QSGHLSR

SEQ ID NO: 5637 - protein, 7 aa, Artificial Sequence
  Description of Artificial Sequence: Synthetic peptide
  Zinc Finger Protein Recognition Helices
RSDNLAR

SEQ ID NO: 5638 - protein, 7 aa, Artificial Sequence
  Description of Artificial Sequence: Synthetic peptide
  Zinc Finger Protein Recognition Helices
HRNTLLG

SEQ ID NO: 5639 - protein, 7 aa, Artificial Sequence
  Description of Artificial Sequence: Synthetic peptide
  Zinc Finger Protein Recognition Helices
TSGSLSR

SEQ ID NO: 5640 - protein, 7 aa, Artificial Sequence
  Description of Artificial Sequence: Synthetic peptide
  Zinc Finger Protein Recognition Helices
RSDHLTT

SEQ ID NO: 5641 - protein, 7 aa, Artificial Sequence
  Description of Artificial Sequence: Synthetic peptide
  Zinc Finger Protein Recognition Helices
QSGDLTR

SEQ ID NO: 5642 - protein, 7 aa, Artificial Sequence
  Description of Artificial Sequence: Synthetic peptide
  Zinc Finger Protein Recognition Helices
RPYTLRL

SEQ ID NO: 5643 - protein, 7 aa, Artificial Sequence
  Description of Artificial Sequence: Synthetic peptide
RSADLTR

SEQ ID NO: 5644 - protein, 7 aa, Artificial Sequence
  Description of Artificial Sequence: Synthetic peptide
RSDALAR

SEQ ID NO: 5645 - protein, 7 aa, Artificial Sequence
  Description of Artificial Sequence: Synthetic peptide
RSDTLSQ

SEQ ID NO: 5646 - protein, 7 aa, Artificial Sequence
  Description of Artificial Sequence: Synthetic peptide
RSDDRKK

SEQ ID NO: 5647 - protein, 7 aa, Artificial Sequence
  Description of Artificial Sequence: Synthetic peptide
TSGSLSR

SEQ ID NO: 5648 - protein, 7 aa, Artificial Sequence
  Description of Artificial Sequence: Synthetic peptide
RSDTLSA

SEQ ID NO: 5649 - protein, 7 aa, Artificial Sequence
  Description of Artificial Sequence: Synthetic peptide
RSADRKK

SEQ ID NO: 5650 - protein, 7 aa, Artificial Sequence
  Description of Artificial Sequence: Synthetic peptide
QRSNLVR

SEQ ID NO: 5651 - protein, 7 aa, Artificial Sequence
  Description of Artificial Sequence: Synthetic peptide
DRSHLAR

SEQ ID NO: 5652 - protein, 7 aa, Artificial Sequence
  Description of Artificial Sequence: Synthetic peptide
RSDALSV

SEQ ID NO: 5653 - protein, 7 aa, Artificial Sequence
  Description of Artificial Sequence: Synthetic peptide
DRSNLSR

SEQ ID NO: 5654 - protein, 7 aa, Artificial Sequence
  Description of Artificial Sequence: Synthetic peptide
QSGNLAR

SEQ ID NO: 5655 - protein, 7 aa, Artificial Sequence
  Description of Artificial Sequence: Synthetic peptide
RSDHLTQ

SEQ ID NO: 5656 - protein, 7 aa, Artificial Sequence
  Description of Artificial Sequence: Synthetic peptide
QSGDLTR

SEQ ID NO: 5657 - protein, 7 aa, Artificial Sequence
  Description of Artificial Sequence: Synthetic peptide
LRHQLKS

SEQ ID NO: 5658 - protein, 7 aa, Artificial Sequence
  Description of Artificial Sequence: Synthetic peptide
RSADLTR

SEQ ID NO: 5659 - protein, 7 aa, Artificial Sequence
  Description of Artificial Sequence: Synthetic peptide
QSGDLTR

SEQ ID NO: 5660 - protein, 7 aa, Artificial Sequence
  Description of Artificial Sequence: Synthetic peptide
DRSHLSR

SEQ ID NO: 5661 - protein, 7 aa, Artificial Sequence
  Description of Artificial Sequence: Synthetic peptide
TSGNLTR

SEQ ID NO: 5662 - protein, 7 aa, Artificial Sequence
  Description of Artificial Sequence: Synthetic peptide
RSDHLSA

SEQ ID NO: 5663 - protein, 7 aa, Artificial Sequence
  Description of Artificial Sequence: Synthetic peptide
TTRYRNR

SEQ ID NO: 5664 - protein, 7 aa, Artificial Sequence
  Description of Artificial Sequence: Synthetic peptide
QSSDLSR

SEQ ID NO: 5665 - protein, 7 aa, Artificial Sequence
  Description of Artificial Sequence: Synthetic peptide
QSGSLTR

SEQ ID NO: 5666 - protein, 7 aa, Artificial Sequence
  Description of Artificial Sequence: Synthetic peptide
QSGHLSR

SEQ ID NO: 5667 - protein, 7 aa, Artificial Sequence
  Description of Artificial Sequence: Synthetic peptide
TSGNLTR

SEQ ID NO: 5668 - protein, 7 aa, Artificial Sequence
  Description of Artificial Sequence: Synthetic peptide
QSGHLSR

SEQ ID NO: 5669 - protein, 7 aa, Artificial Sequence
  Description of Artificial Sequence: Synthetic peptide
QSGNLAR

SEQ ID NO: 5670 - protein, 7 aa, Artificial Sequence
  Description of Artificial Sequence: Synthetic peptide
DISNRSK

SEQ ID NO: 5671 - protein, 7 aa, Artificial Sequence
  Description of Artificial Sequence: Synthetic peptide
DRSDLSR

SEQ ID NO: 5672 - protein, 7 aa, Artificial Sequence
  Description of Artificial Sequence: Synthetic peptide
RRTDLRR

SEQ ID NO: 5673 - protein, 7 aa, Artificial Sequence
  Description of Artificial Sequence: Synthetic peptide
TSGSLTR

SEQ ID NO: 5674 - protein, 7 aa, Artificial Sequence
  Description of Artificial Sequence: Synthetic peptide
DRSHLSR

SEQ ID NO: 5675 - protein, 7 aa, Artificial Sequence
  Description of Artificial Sequence: Synthetic peptide
TSGNLTR

SEQ ID NO: 5676 - protein, 7 aa, Artificial Sequence
  Description of Artificial Sequence: Synthetic peptide
DRSNLSR

SEQ ID NO: 5677 - protein, 7 aa, Artificial Sequence
  Description of Artificial Sequence: Synthetic peptide
FPGSRTR

SEQ ID NO: 5678 - protein, 7 aa, Artificial Sequence
  Description of Artificial Sequence: Synthetic peptide
RNDDRKK

SEQ ID NO: 5679 - protein, 7 aa, Artificial Sequence
  Description of Artificial Sequence: Synthetic peptide
TSGSLSR

SEQ ID NO: 5680 - protein, 7 aa, Artificial Sequence
  Description of Artificial Sequence: Synthetic peptide
QLNNLKT

SEQ ID NO: 5681 - protein, 7 aa, Artificial Sequence
  Description of Artificial Sequence: Synthetic peptide
RSDVLST

SEQ ID NO: 5682 - protein, 7 aa, Artificial Sequence
  Description of Artificial Sequence: Synthetic peptide
ASGNLLN

SEQ ID NO: 5683 - protein, 7 aa, Artificial Sequence
  Description of Artificial Sequence: Synthetic peptide
RSDNLSR

SEQ ID NO: 5684 - protein, 7 aa, Artificial Sequence
  Description of Artificial Sequence: Synthetic peptide
DNSNRKT

SEQ ID NO: 5685 - protein, 7 aa, Artificial Sequence
  Description of Artificial Sequence: Synthetic peptide
RSDTLSQ

SEQ ID NO: 5686 - protein, 7 aa, Artificial Sequence
  Description of Artificial Sequence: Synthetic peptide
ASANRTK

SEQ ID NO: 5687 - protein, 7 aa, Artificial Sequence
  Description of Artificial Sequence: Synthetic peptide
QSSNLAR

SEQ ID NO: 5688 - protein, 7 aa, Artificial Sequence
  Description of Artificial Sequence: Synthetic peptide
DSSDRKK

SEQ ID NO: 5689 - protein, 7 aa, Artificial Sequence
  Description of Artificial Sequence: Synthetic peptide
RSDHLST

SEQ ID NO: 5690 - protein, 7 aa, Artificial Sequence
  Description of Artificial Sequence: Synthetic peptide
QSGHLSR

SEQ ID NO: 5691 - protein, 7 aa, Artificial Sequence
  Description of Artificial Sequence: Synthetic peptide
RSDHLSA

SEQ ID NO: 5692 - protein, 7 aa, Artificial Sequence
  Description of Artificial Sequence: Synthetic peptide
SYWSRTV

SEQ ID NO: 5693 - protein, 7 aa, Artificial Sequence
  Description of Artificial Sequence: Synthetic peptide
DRSALSR

SEQ ID NO: 5694 - protein, 7 aa, Artificial Sequence
  Description of Artificial Sequence: Synthetic peptide
DRSHLAR

SEQ ID NO: 5695 - protein, 7 aa, Artificial Sequence
  Description of Artificial Sequence: Synthetic peptide
RSDNLTR

SEQ ID NO: 5696 - protein, 7 aa, Artificial Sequence
  Description of Artificial Sequence: Synthetic peptide
DRSDLSR

SEQ ID NO: 5697 - protein, 7 aa, Artificial Sequence
  Description of Artificial Sequence: Synthetic peptide
DRSNRNK

SEQ ID NO: 5698 - protein, 7 aa, Artificial Sequence
  Description of Artificial Sequence: Synthetic peptide
RSDVLSE

SEQ ID NO: 5699 - protein, 7 aa, Artificial Sequence
  Description of Artificial Sequence: Synthetic peptide
RNFSLTM

SEQ ID NO: 5700 - protein, 7 aa, Artificial Sequence
  Description of Artificial Sequence: Synthetic peptide
RSDALAR

SEQ ID NO: 5701 - protein, 7 aa, Artificial Sequence
  Description of Artificial Sequence: Synthetic peptide
QSGALAR

SEQ ID NO: 5702 - protein, 7 aa, Artificial Sequence
  Description of Artificial Sequence: Synthetic peptide
QSSDLSR

SEQ ID NO: 5703 - protein, 7 aa, Artificial Sequence
  Description of Artificial Sequence: Synthetic peptide
RRDILHQ

SEQ ID NO: 5704 - protein, 7 aa, Artificial Sequence
  Description of Artificial Sequence: Synthetic peptide
RSADLTR

SEQ ID NO: 5705 - protein, 7 aa, Artificial Sequence
  Description of Artificial Sequence: Synthetic peptide
QSGDLTR

SEQ ID NO: 5706 - protein, 7 aa, Artificial Sequence
  Description of Artificial Sequence: Synthetic peptide
QSGALAR

SEQ ID NO: 5707 - protein, 7 aa, Artificial Sequence
  Description of Artificial Sequence: Synthetic peptide
DRSNLSR

SEQ ID NO: 5708 - protein, 7 aa, Artificial Sequence
  Description of Artificial Sequence: Synthetic peptide
LKQHLTR

SEQ ID NO: 5709 - protein, 7 aa, Artificial Sequence
  Description of Artificial Sequence: Synthetic peptide
RSDNLST

SEQ ID NO: 5710 - protein, 7 aa, Artificial Sequence
  Description of Artificial Sequence: Synthetic peptide
RSDHLSR

SEQ ID NO: 5711 - protein, 7 aa, Artificial Sequence
  Description of Artificial Sequence: Synthetic peptide
QSSDLSR

SEQ ID NO: 5712 - protein, 7 aa, Artificial Sequence
  Description of Artificial Sequence: Synthetic peptide
HRSNLNK

SEQ ID NO: 5713 - protein, 7 aa, Artificial Sequence
  Description of Artificial Sequence: Synthetic peptide
DRSNLSR

SEQ ID NO: 5714 - protein, 7 aa, Artificial Sequence
  Description of Artificial Sequence: Synthetic peptide
DASNLRQ

SEQ ID NO: 5715 - protein, 7 aa, Artificial Sequence
  Description of Artificial Sequence: Synthetic peptide
TSSNLSR

SEQ ID NO: 5716 - protein, 7 aa, Artificial Sequence
  Description of Artificial Sequence: Synthetic peptide
RSDSLLR

SEQ ID NO: 5717 - protein, 7 aa, Artificial Sequence
  Description of Artificial Sequence: Synthetic peptide
CREYRGK

SEQ ID NO: 5718 - protein, 7 aa, Artificial Sequence
  Description of Artificial Sequence: Synthetic peptide
TSGHLSR

SEQ ID NO: 5719 - protein, 7 aa, Artificial Sequence
  Description of Artificial Sequence: Synthetic peptide
RSDVLSA

SEQ ID NO: 5720 - protein, 7 aa, Artificial Sequence
  Description of Artificial Sequence: Synthetic peptide
RNDHRIN

SEQ ID NO: 5721 - protein, 7 aa, Artificial Sequence
  Description of Artificial Sequence: Synthetic peptide
QSGSLTR

SEQ ID NO: 5722 - protein, 7 aa, Artificial Sequence
  Description of Artificial Sequence: Synthetic peptide
RSDNLRE

SEQ ID NO: 5723 - protein, 7 aa, Artificial Sequence
  Description of Artificial Sequence: Synthetic peptide
QSGSLTR

SEQ ID NO: 5724 - protein, 7 aa, Artificial Sequence
  Description of Artificial Sequence: Synthetic peptide
RLDNRTA

SEQ ID NO: 5725 - protein, 7 aa, Artificial Sequence
  Description of Artificial Sequence: Synthetic peptide
RSDVLSN

SEQ ID NO: 5726 - protein, 7 aa, Artificial Sequence
  Description of Artificial Sequence: Synthetic peptide
DRSTRIT

SEQ ID NO: 5727 - protein, 7 aa, Artificial Sequence
  Description of Artificial Sequence: Synthetic peptide
RSDSLLR

SEQ ID NO: 5728 - protein, 7 aa, Artificial Sequence
  Description of Artificial Sequence: Synthetic peptide
WLSSLSA

SEQ ID NO: 5729 - protein, 7 aa, Artificial Sequence
  Description of Artificial Sequence: Synthetic peptide
ERGTLAR

SEQ ID NO: 5730 - protein, 7 aa, Artificial Sequence
  Description of Artificial Sequence: Synthetic peptide
TSGSLTR

SEQ ID NO: 5731 - protein, 7 aa, Artificial Sequence
  Description of Artificial Sequence: Synthetic peptide
RSDTLSE

SEQ ID NO: 5732 - protein, 7 aa, Artificial Sequence
  Description of Artificial Sequence: Synthetic peptide
QSGHLSR

SEQ ID NO: 5733 - protein, 7 aa, Artificial Sequence
  Description of Artificial Sequence: Synthetic peptide
QSGNLAR

SEQ ID NO: 5734 - protein, 7 aa, Artificial Sequence
  Description of Artificial Sequence: Synthetic peptide
DISNRSK

SEQ ID NO: 5735 - protein, 7 aa, Artificial Sequence
  Description of Artificial Sequence: Synthetic peptide
RSDHLSR

SEQ ID NO: 5736 - protein, 7 aa, Artificial Sequence
  Description of Artificial Sequence: Synthetic peptide
HRYHRLS

SEQ ID NO: 5737 - protein, 7 aa, Artificial Sequence
  Description of Artificial Sequence: Synthetic peptide
QSGSLTR

SEQ ID NO: 5738 - protein, 7 aa, Artificial Sequence
  Description of Artificial Sequence: Synthetic peptide
DRSHLAR

SEQ ID NO: 5739 - protein, 7 aa, Artificial Sequence
  Description of Artificial Sequence: Synthetic peptide
DRSALSR

SEQ ID NO: 5740 - protein, 7 aa, Artificial Sequence
  Description of Artificial Sequence: Synthetic peptide
RSDALAR

SEQ ID NO: 5741 - protein, 7 aa, Artificial Sequence
  Description of Artificial Sequence: Synthetic peptide
QSSDLSR

SEQ ID NO: 5742 - protein, 7 aa, Artificial Sequence
  Description of Artificial Sequence: Synthetic peptide
HKYHLRS

SEQ ID NO: 5743 - protein, 7 aa, Artificial Sequence
  Description of Artificial Sequence: Synthetic peptide
RSDHLSE

SEQ ID NO: 5744 - protein, 7 aa, Artificial Sequence
  Description of Artificial Sequence: Synthetic peptide
RKDARIT

SEQ ID NO: 5745 - protein, 7 aa, Artificial Sequence
  Description of Artificial Sequence: Synthetic peptide
ERGTLAR

SEQ ID NO: 5746 - protein, 7 aa, Artificial Sequence
  Description of Artificial Sequence: Synthetic peptide
RSDALTQ

SEQ ID NO: 5747 - protein, 7 aa, Artificial Sequence
  Description of Artificial Sequence: Synthetic peptide
DRSHLTR

SEQ ID NO: 5748 - protein, 7 aa, Artificial Sequence
  Description of Artificial Sequence: Synthetic peptide
RSDHLTT

SEQ ID NO: 5749 - protein, 7 aa, Artificial Sequence
  Description of Artificial Sequence: Synthetic peptide
TSGSLSR

SEQ ID NO: 5750 - protein, 7 aa, Artificial Sequence
  Description of Artificial Sequence: Synthetic peptide
QMHHLKT

SEQ ID NO: 5751 - protein, 7 aa, Artificial Sequence
  Description of Artificial Sequence: Synthetic peptide
TSSNLSR

SEQ ID NO: 5752 - protein, 7 aa, Artificial Sequence
  Description of Artificial Sequence: Synthetic peptide
QSGALAR

SEQ ID NO: 5753 - protein, 7 aa, Artificial Sequence
  Description of Artificial Sequence: Synthetic peptide
RSDDLTR

SEQ ID NO: 5754 - protein, 7 aa, Artificial Sequence
  Description of Artificial Sequence: Synthetic peptide
DRSALSR

SEQ ID NO: 5755 - protein, 7 aa, Artificial Sequence
  Description of Artificial Sequence: Synthetic peptide
RSDHLSR

SEQ ID NO: 5756 - protein, 7 aa, Artificial Sequence
  Description of Artificial Sequence: Synthetic peptide
DRSARTR

SEQ ID NO: 5757 - protein, 7 aa, Artificial Sequence
  Description of Artificial Sequence: Synthetic peptide
QSGHLSR

SEQ ID NO: 5758 - protein, 7 aa, Artificial Sequence
  Description of Artificial Sequence: Synthetic peptide
RSDHLSE

SEQ ID NO: 5759 - protein, 7 aa, Artificial Sequence
  Description of Artificial Sequence: Synthetic peptide
ARSTRTN

SEQ ID NO: 5760 - protein, 7 aa, Artificial Sequence
  Description of Artificial Sequence: Synthetic peptide
RSANLAR

SEQ ID NO: 5761 - protein, 7 aa, Artificial Sequence
  Description of Artificial Sequence: Synthetic peptide
RNDDRKK

SEQ ID NO: 5762 - protein, 7 aa, Artificial Sequence
  Description of Artificial Sequence: Synthetic peptide
DRSHLTR

SEQ ID NO: 5763 - protein, 7 aa, Artificial Sequence
  Description of Artificial Sequence: Synthetic peptide
DRSNLTR

SEQ ID NO: 5764 - protein, 7 aa, Artificial Sequence
  Description of Artificial Sequence: Synthetic peptide
TSGSLSR

SEQ ID NO: 5765 - protein, 7 aa, Artificial Sequence
  Description of Artificial Sequence: Synthetic peptide
DSSDRKK

SEQ ID NO: 5766 - protein, 7 aa, Artificial Sequence
  Description of Artificial Sequence: Synthetic peptide
QSGDLTR

SEQ ID NO: 5767 - protein, 7 aa, Artificial Sequence
  Description of Artificial Sequence: Synthetic peptide
DRSHLTR

SEQ ID NO: 5768 - protein, 7 aa, Artificial Sequence
  Description of Artificial Sequence: Synthetic peptide
DRSHLAR

SEQ ID NO: 5769 - protein, 7 aa, Artificial Sequence
  Description of Artificial Sequence: Synthetic peptide
RSDHLSA

SEQ ID NO: 5770 - protein, 7 aa, Artificial Sequence
  Description of Artificial Sequence: Synthetic peptide
TKSNRTK

SEQ ID NO: 5771 - protein, 7 aa, Artificial Sequence
  Description of Artificial Sequence: Synthetic peptide
DRSNLTR

SEQ ID NO: 5772 - protein, 7 aa, Artificial Sequence
  Description of Artificial Sequence: Synthetic peptide
RSDDLTR

SEQ ID NO: 5773 - protein, 7 aa, Artificial Sequence
  Description of Artificial Sequence: Synthetic peptide
QKSSLRT

SEQ ID NO: 5774 - protein, 7 aa, Artificial Sequence
  Description of Artificial Sequence: Synthetic peptide
RREDLIT

SEQ ID NO: 5775 - protein, 7 aa, Artificial Sequence
  Description of Artificial Sequence: Synthetic peptide
TSSNLSR

SEQ ID NO: 5776 - protein, 7 aa, Artificial Sequence
  Description of Artificial Sequence: Synthetic peptide
DRSALSR

SEQ ID NO: 5777 - protein, 7 aa, Artificial Sequence
  Description of Artificial Sequence: Synthetic peptide
RSDDRKT

SEQ ID NO: 5778 - protein, 7 aa, Artificial Sequence
  Description of Artificial Sequence: Synthetic peptide
RSDTLSE

SEQ ID NO: 5779 - protein, 7 aa, Artificial Sequence
  Description of Artificial Sequence: Synthetic peptide
HRRSRWG

SEQ ID NO: 5780 - protein, 7 aa, Artificial Sequence
  Description of Artificial Sequence: Synthetic peptide
RSDNLSA

SEQ ID NO: 5781 - protein, 7 aa, Artificial Sequence
  Description of Artificial Sequence: Synthetic peptide
RNNDRKT

SEQ ID NO: 5782 - protein, 7 aa, Artificial Sequence
  Description of Artificial Sequence: Synthetic peptide
QSGDLTR

SEQ ID NO: 5783 - protein, 7 aa, Artificial Sequence
  Description of Artificial Sequence: Synthetic peptide
RSDDLTR

SEQ ID NO: 5784 - protein, 7 aa, Artificial Sequence
  Description of Artificial Sequence: Synthetic peptide
QSSDLSR

SEQ ID NO: 5785 - protein, 7 aa, Artificial Sequence
  Description of Artificial Sequence: Synthetic peptide
HKYHLRS

SEQ ID NO: 5786 - protein, 7 aa, Artificial Sequence
  Description of Artificial Sequence: Synthetic peptide
TNQNRIT

SEQ ID NO: 5787 - protein, 7 aa, Artificial Sequence
  Description of Artificial Sequence: Synthetic peptide
HRSSLRR

SEQ ID NO: 5788 - protein, 7 aa, Artificial Sequence
  Description of Artificial Sequence: Synthetic peptide
DSSTRKT

SEQ ID NO: 5789 - protein, 7 aa, Artificial Sequence
  Description of Artificial Sequence: Synthetic peptide
QSATRTK

SEQ ID NO: 5790 - protein, 7 aa, Artificial Sequence
  Description of Artificial Sequence: Synthetic peptide
QSSDLSR

SEQ ID NO: 5791 - protein, 7 aa, Artificial Sequence
  Description of Artificial Sequence: Synthetic peptide
HRKSLSR

SEQ ID NO: 5792 - protein, 7 aa, Artificial Sequence
  Description of Artificial Sequence: Synthetic peptide
QSSDLSR

SEQ ID NO: 5793 - protein, 7 aa, Artificial Sequence
  Description of Artificial Sequence: Synthetic peptide
QSTHRNA

SEQ ID NO: 5794 - protein, 7 aa, Artificial Sequence
  Description of Artificial Sequence: Synthetic peptide
RSDHLTQ

SEQ ID NO: 5795 - protein, 7 aa, Artificial Sequence
  Description of Artificial Sequence: Synthetic peptide
DRSDLSR

SEQ ID NO: 5796 - protein, 7 aa, Artificial Sequence
  Description of Artificial Sequence: Synthetic peptide
RSDNLTR

SEQ ID NO: 5797 - protein, 7 aa, Artificial Sequence
  Description of Artificial Sequence: Synthetic peptide
QSGDLTR

SEQ ID NO: 5798 - protein, 7 aa, Artificial Sequence
  Description of Artificial Sequence: Synthetic peptide
DRSHLTR

SEQ ID NO: 5799 - protein, 7 aa, Artificial Sequence
  Description of Artificial Sequence: Synthetic peptide
QSGSLTR

SEQ ID NO: 5800 - protein, 7 aa, Artificial Sequence
  Description of Artificial Sequence: Synthetic peptide
DRSNLSR

SEQ ID NO: 5801 - protein, 7 aa, Artificial Sequence
  Description of Artificial Sequence: Synthetic peptide
QSGNLAR

SEQ ID NO: 5802 - protein, 7 aa, Artificial Sequence
  Description of Artificial Sequence: Synthetic peptide
DRSALSR

SEQ ID NO: 5803 - protein, 7 aa, Artificial Sequence
  Description of Artificial Sequence: Synthetic peptide
RSDALTQ

SEQ ID NO: 5804 - protein, 7 aa, Artificial Sequence
  Description of Artificial Sequence: Synthetic peptide
RSDSLLR

SEQ ID NO: 5805 - protein, 7 aa, Artificial Sequence
  Description of Artificial Sequence: Synthetic peptide
RSDALTQ

SEQ ID NO: 5806 - protein, 7 aa, Artificial Sequence
  Description of Artificial Sequence: Synthetic peptide
RSDNLST

SEQ ID NO: 5807 - protein, 7 aa, Artificial Sequence
  Description of Artificial Sequence: Synthetic peptide
DNSNRIN

SEQ ID NO: 5808 - protein, 7 aa, Artificial Sequence
  Description of Artificial Sequence: Synthetic peptide
RSDNLST

SEQ ID NO: 5809 - protein, 7 aa, Artificial Sequence
  Description of Artificial Sequence: Synthetic peptide
RSDNRTK

SEQ ID NO: 5810 - protein, 7 aa, Artificial Sequence
  Description of Artificial Sequence: Synthetic peptide
RSDVLST

SEQ ID NO: 5811 - protein, 7 aa, Artificial Sequence
  Description of Artificial Sequence: Synthetic peptide
WSSSRAA

SEQ ID NO: 5812 - protein, 7 aa, Artificial Sequence
  Description of Artificial Sequence: Synthetic peptide
QSGSLTR

SEQ ID NO: 5813 - protein, 7 aa, Artificial Sequence
  Description of Artificial Sequence: Synthetic peptide
TSSNRKT

SEQ ID NO: 5814 - protein, 7 aa, Artificial Sequence
  Description of Artificial Sequence: Synthetic peptide
QSSHLTR

SEQ ID NO: 5815 - protein, 7 aa, Artificial Sequence
  Description of Artificial Sequence: Synthetic peptide
RSDALTQ

SEQ ID NO: 5816 - protein, 7 aa, Artificial Sequence
  Description of Artificial Sequence: Synthetic peptide
ERGTLAR

SEQ ID NO: 5817 - protein, 7 aa, Artificial Sequence
  Description of Artificial Sequence: Synthetic peptide
RNDDRKK

SEQ ID NO: 5818 - protein, 7 aa, Artificial Sequence
  Description of Artificial Sequence: Synthetic peptide
QSGSLTR

SEQ ID NO: 5819 - protein, 7 aa, Artificial Sequence
  Description of Artificial Sequence: Synthetic peptide
TSSNRKT

SEQ ID NO: 5820 - protein, 7 aa, Artificial Sequence
  Description of Artificial Sequence: Synthetic peptide
RSDNLSV

SEQ ID NO: 5821 - protein, 7 aa, Artificial Sequence
  Description of Artificial Sequence: Synthetic peptide
QNANRIT

SEQ ID NO: 5822 - protein, 7 aa, Artificial Sequence
  Description of Artificial Sequence: Synthetic peptide
ERGTLAR

SEQ ID NO: 5823 - protein, 7 aa, Artificial Sequence
  Description of Artificial Sequence: Synthetic peptide
RSDDLTR

SEQ ID NO: 5824 - protein, 7 aa, Artificial Sequence
  Description of Artificial Sequence: Synthetic peptide
RSDNLSE

SEQ ID NO: 5825 - protein, 7 aa, Artificial Sequence
  Description of Artificial Sequence: Synthetic peptide
RHSALSA

SEQ ID NO: 5826 - protein, 7 aa, Artificial Sequence
  Description of Artificial Sequence: Synthetic peptide
QSSDLSR

SEQ ID NO: 5827 - protein, 7 aa, Artificial Sequence
  Description of Artificial Sequence: Synthetic peptide
QSYNRFV

SEQ ID NO: 5828 - protein, 7 aa, Artificial Sequence
  Description of Artificial Sequence: Synthetic peptide
ERGTLAR

SEQ ID NO: 5829 - protein, 7 aa, Artificial Sequence
  Description of Artificial Sequence: Synthetic peptide
TSGSLTR

SEQ ID NO: 5830 - protein, 7 aa, Artificial Sequence
  Description of Artificial Sequence: Synthetic peptide
ERGTLAR

SEQ ID NO: 5831 - protein, 7 aa, Artificial Sequence
  Description of Artificial Sequence: Synthetic peptide
RSDDLTR

SEQ ID NO: 5832 - protein, 7 aa, Artificial Sequence
  Description of Artificial Sequence: Synthetic peptide
RSDHLSE

SEQ ID NO: 5833 - protein, 7 aa, Artificial Sequence
  Description of Artificial Sequence: Synthetic peptide
RNQHRKN

SEQ ID NO: 5834 - protein, 7 aa, Artificial Sequence
  Description of Artificial Sequence: Synthetic peptide
DRSHLAR

SEQ ID NO: 5835 - protein, 7 aa, Artificial Sequence
  Description of Artificial Sequence: Synthetic peptide
QSGNLAR

SEQ ID NO: 5836 - protein, 7 aa, Artificial Sequence
  Description of Artificial Sequence: Synthetic peptide
QGANLIK

SEQ ID NO: 5837 - protein, 7 aa, Artificial Sequence
  Description of Artificial Sequence: Synthetic peptide
RSDSLSV

SEQ ID NO: 5838 - protein, 7 aa, Artificial Sequence
  Description of Artificial Sequence: Synthetic peptide
DRSDLSR

SEQ ID NO: 5839 - protein, 7 aa, Artificial Sequence
  Description of Artificial Sequence: Synthetic peptide
QSGHLSR

SEQ ID NO: 5840 - protein, 7 aa, Artificial Sequence
  Description of Artificial Sequence: Synthetic peptide
TSGSLSR

SEQ ID NO: 5841 - protein, 7 aa, Artificial Sequence
  Description of Artificial Sequence: Synthetic peptide
QSGSLTR

SEQ ID NO: 5842 - protein, 7 aa, Artificial Sequence
  Description of Artificial Sequence: Synthetic peptide
RSAHLSR

SEQ ID NO: 5843 - protein, 7 aa, Artificial Sequence
  Description of Artificial Sequence: Synthetic peptide
RSDALST

SEQ ID NO: 5844 - protein, 7 aa, Artificial Sequence
  Description of Artificial Sequence: Synthetic peptide
DRSTRTK

SEQ ID NO: 5845 - protein, 7 aa, Artificial Sequence
  Description of Artificial Sequence: Synthetic peptide
RSDDLSK

SEQ ID NO: 5846 - protein, 7 aa, Artificial Sequence
  Description of Artificial Sequence: Synthetic peptide
QSATRTK

SEQ ID NO: 5847 - protein, 7 aa, Artificial Sequence
  Description of Artificial Sequence: Synthetic peptide
RSDALTQ

SEQ ID NO: 5848 - protein, 7 aa, Artificial Sequence
  Description of Artificial Sequence: Synthetic peptide
DRSHLTR

SEQ ID NO: 5849 - protein, 7 aa, Artificial Sequence
  Description of Artificial Sequence: Synthetic peptide
TSSNRKT

SEQ ID NO: 5850 - protein, 7 aa, Artificial Sequence
  Description of Artificial Sequence: Synthetic peptide
DRSALSR

SEQ ID NO: 5851 - protein, 7 aa, Artificial Sequence
  Description of Artificial Sequence: Synthetic peptide
TSSNRKT

SEQ ID NO: 5852 - protein, 7 aa, Artificial Sequence
  Description of Artificial Sequence: Synthetic peptide
RSADLTR

SEQ ID NO: 5853 - protein, 7 aa, Artificial Sequence
  Description of Artificial Sequence: Synthetic peptide
RSDDLTR

SEQ ID NO: 5854 - protein, 7 aa, Artificial Sequence
  Description of Artificial Sequence: Synthetic peptide
RSDVLST

SEQ ID NO: 5855 - protein, 7 aa, Artificial Sequence
  Description of Artificial Sequence: Synthetic peptide
DCRNRWR

SEQ ID NO: 5856 - protein, 7 aa, Artificial Sequence
  Description of Artificial Sequence: Synthetic peptide
QSSDLSR

SEQ ID NO: 5857 - protein, 7 aa, Artificial Sequence
  Description of Artificial Sequence: Synthetic peptide
QSGSLTR

SEQ ID NO: 5858 - protein, 7 aa, Artificial Sequence
  Description of Artificial Sequence: Synthetic peptide
QSSDLSR

SEQ ID NO: 5859 - protein, 7 aa, Artificial Sequence
  Description of Artificial Sequence: Synthetic peptide
RSDNLST

SEQ ID NO: 5860 - protein, 7 aa, Artificial Sequence
  Description of Artificial Sequence: Synthetic peptide
RSDNRTK

SEQ ID NO: 5861 - protein, 7 aa, Artificial Sequence
  Description of Artificial Sequence: Synthetic peptide
QSSDLSR

SEQ ID NO: 5862 - protein, 7 aa, Artificial Sequence
  Description of Artificial Sequence: Synthetic peptide
AASNRSK

SEQ ID NO: 5863 - protein, 7 aa, Artificial Sequence
  Description of Artificial Sequence: Synthetic peptide
DRSHLSR

SEQ ID NO: 5864 - protein, 7 aa, Artificial Sequence
  Description of Artificial Sequence: Synthetic peptide
DRSHLAR

SEQ ID NO: 5865 - protein, 7 aa, Artificial Sequence
  Description of Artificial Sequence: Synthetic peptide
RSDTLSA

SEQ ID NO: 5866 - protein, 7 aa, Artificial Sequence
  Description of Artificial Sequence: Synthetic peptide
RSADRKK

SEQ ID NO: 5867 - protein, 7 aa, Artificial Sequence
  Description of Artificial Sequence: Synthetic peptide
RSDNLST

SEQ ID NO: 5868 - protein, 7 aa, Artificial Sequence
  Description of Artificial Sequence: Synthetic peptide
DRSNRKT

SEQ ID NO: 5869 - protein, 7 aa, Artificial Sequence
  Description of Artificial Sequence: Synthetic peptide
RSDALAR

SEQ ID NO: 5870 - protein, 7 aa, Artificial Sequence
  Description of Artificial Sequence: Synthetic peptide
RSDNLST

SEQ ID NO: 5871 - protein, 7 aa, Artificial Sequence
  Description of Artificial Sequence: Synthetic peptide
DRSALAR

SEQ ID NO: 5872 - protein, 7 aa, Artificial Sequence
  Description of Artificial Sequence: Synthetic peptide
DRSDLSR

SEQ ID NO: 5873 - protein, 7 aa, Artificial Sequence
  Description of Artificial Sequence: Synthetic peptide
DRSNRNK

SEQ ID NO: 5874 - protein, 7 aa, Artificial Sequence
  Description of Artificial Sequence: Synthetic peptide
QSSDLSR

SEQ ID NO: 5875 - protein, 7 aa, Artificial Sequence
  Description of Artificial Sequence: Synthetic peptide
WRSSLRQ

SEQ ID NO: 5876 - protein, 7 aa, Artificial Sequence
  Description of Artificial Sequence: Synthetic peptide
RSDHLSQ

SEQ ID NO: 5877 - protein, 7 aa, Artificial Sequence
  Description of Artificial Sequence: Synthetic peptide
TRSPLTT

SEQ ID NO: 5878 - protein, 7 aa, Artificial Sequence
  Description of Artificial Sequence: Synthetic peptide
TRDHLST

SEQ ID NO: 5879 - protein, 7 aa, Artificial Sequence
  Description of Artificial Sequence: Synthetic peptide
RSDARTN

SEQ ID NO: 5880 - protein, 7 aa, Artificial Sequence
  Description of Artificial Sequence: Synthetic peptide
RSDHLSE

SEQ ID NO: 5881 - protein, 7 aa, Artificial Sequence
  Description of Artificial Sequence: Synthetic peptide
QSNHRKT

SEQ ID NO: 5882 - protein, 7 aa, Artificial Sequence
  Description of Artificial Sequence: Synthetic peptide
RSDALAR

SEQ ID NO: 5883 - protein, 7 aa, Artificial Sequence
  Description of Artificial Sequence: Synthetic peptide
ERGTLAR

SEQ ID NO: 5884 - protein, 7 aa, Artificial Sequence
  Description of Artificial Sequence: Synthetic peptide
RSDALTQ

SEQ ID NO: 5885 - protein, 7 aa, Artificial Sequence
  Description of Artificial Sequence: Synthetic peptide
RSDSLSV

SEQ ID NO: 5886 - protein, 7 aa, Artificial Sequence
  Description of Artificial Sequence: Synthetic peptide
DRSALAR

SEQ ID NO: 5887 - protein, 7 aa, Artificial Sequence
  Description of Artificial Sequence: Synthetic peptide
QSSNLAR

SEQ ID NO: 5888 - protein, 7 aa, Artificial Sequence
  Description of Artificial Sequence: Synthetic peptide
QSADRTK

SEQ ID NO: 5889 - protein, 7 aa, Artificial Sequence
  Description of Artificial Sequence: Synthetic peptide
RSDHLSA

SEQ ID NO: 5890 - protein, 7 aa, Artificial Sequence
  Description of Artificial Sequence: Synthetic peptide
QSGDLTR

SEQ ID NO: 5891 - protein, 7 aa, Artificial Sequence
  Description of Artificial Sequence: Synthetic peptide
QSSDLSR

SEQ ID NO: 5892 - protein, 7 aa, Artificial Sequence
  Description of Artificial Sequence: Synthetic peptide
RSDNLAR

SEQ ID NO: 5893 - protein, 7 aa, Artificial Sequence
  Description of Artificial Sequence: Synthetic peptide
FREGLYK

SEQ ID NO: 5894 - protein, 7 aa, Artificial Sequence
  Description of Artificial Sequence: Synthetic peptide
TSGNLTR

SEQ ID NO: 5895 - protein, 7 aa, Artificial Sequence
  Description of Artificial Sequence: Synthetic peptide
LKQMLAV

SEQ ID NO: 5896 - protein, 7 aa, Artificial Sequence
  Description of Artificial Sequence: Synthetic peptide
ERGTLAR

SEQ ID NO: 5897 - protein, 7 aa, Artificial Sequence
  Description of Artificial Sequence: Synthetic peptide
RSDHLSR

SEQ ID NO: 5898 - protein, 7 aa, Artificial Sequence
  Description of Artificial Sequence: Synthetic peptide
QSSHLTR

SEQ ID NO: 5899 - protein, 7 aa, Artificial Sequence
  Description of Artificial Sequence: Synthetic peptide
QSSDLTR

SEQ ID NO: 5900 - protein, 7 aa, Artificial Sequence
  Description of Artificial Sequence: Synthetic peptide
RSDTLSE

SEQ ID NO: 5901 - protein, 7 aa, Artificial Sequence
  Description of Artificial Sequence: Synthetic peptide
HRRSRWG

SEQ ID NO: 5902 - protein, 7 aa, Artificial Sequence
  Description of Artificial Sequence: Synthetic peptide
RSDDLSV

SEQ ID NO: 5903 - protein, 7 aa, Artificial Sequence
  Description of Artificial Sequence: Synthetic peptide
TSSNRTK

SEQ ID NO: 5904 - protein, 7 aa, Artificial Sequence
  Description of Artificial Sequence: Synthetic peptide
RSDTLSQ

SEQ ID NO: 5905 - protein, 7 aa, Artificial Sequence
  Description of Artificial Sequence: Synthetic peptide
QRDHRIK

SEQ ID NO: 5906 - protein, 7 aa, Artificial Sequence
  Description of Artificial Sequence: Synthetic peptide
DRSNLSR

SEQ ID NO: 5907 - protein, 7 aa, Artificial Sequence
  Description of Artificial Sequence: Synthetic peptide
TSGNLTR

SEQ ID NO: 5908 - protein, 7 aa, Artificial Sequence
  Description of Artificial Sequence: Synthetic peptide
RSDSLLR

SEQ ID NO: 5909 - protein, 7 aa, Artificial Sequence
  Description of Artificial Sequence: Synthetic peptide
WLSSLSA

SEQ ID NO: 5910 - protein, 7 aa, Artificial Sequence
  Description of Artificial Sequence: Synthetic peptide
DRSNLSR

SEQ ID NO: 5911 - protein, 7 aa, Artificial Sequence
  Description of Artificial Sequence: Synthetic peptide
LRQNLIM

SEQ ID NO: 5912 - protein, 7 aa, Artificial Sequence
  Description of Artificial Sequence: Synthetic peptide
QNAHRKT

SEQ ID NO: 5913 - protein, 7 aa, Artificial Sequence
  Description of Artificial Sequence: Synthetic peptide
QSGALAR

SEQ ID NO: 5914 - protein, 7 aa, Artificial Sequence
  Description of Artificial Sequence: Synthetic peptide
QSGHLSR

SEQ ID NO: 5915 - protein, 7 aa, Artificial Sequence
  Description of Artificial Sequence: Synthetic peptide
QSGNLAR

SEQ ID NO: 5916 - protein, 7 aa, Artificial Sequence
  Description of Artificial Sequence: Synthetic peptide
LAYDRRK

SEQ ID NO: 5917 - protein, 7 aa, Artificial Sequence
  Description of Artificial Sequence: Synthetic peptide
RSDVLSE

SEQ ID NO: 5918 - protein, 7 aa, Artificial Sequence
  Description of Artificial Sequence: Synthetic peptide
RNFSLTM

SEQ ID NO: 5919 - protein, 7 aa, Artificial Sequence
  Description of Artificial Sequence: Synthetic peptide
RSADLTR

SEQ ID NO: 5920 - protein, 7 aa, Artificial Sequence
  Description of Artificial Sequence: Synthetic peptide
DSSDRKK

SEQ ID NO: 5921 - protein, 7 aa, Artificial Sequence
  Description of Artificial Sequence: Synthetic peptide
RSDNLAR

SEQ ID NO: 5922 - protein, 7 aa, Artificial Sequence
  Description of Artificial Sequence: Synthetic peptide
DQSYRRT

SEQ ID NO: 5923 - protein, 7 aa, Artificial Sequence
  Description of Artificial Sequence: Synthetic peptide
RSDNLSE

SEQ ID NO: 5924 - protein, 7 aa, Artificial Sequence
  Description of Artificial Sequence: Synthetic peptide
TSSNRKT

SEQ ID NO: 5925 - protein, 7 aa, Artificial Sequence
  Description of Artificial Sequence: Synthetic peptide
TSGSLSR

SEQ ID NO: 5926 - protein, 7 aa, Artificial Sequence
  Description of Artificial Sequence: Synthetic peptide
RKELLRS

SEQ ID NO: 5927 - protein, 7 aa, Artificial Sequence
  Description of Artificial Sequence: Synthetic peptide
RPYTLRL

SEQ ID NO: 5928 - protein, 7 aa, Artificial Sequence
  Description of Artificial Sequence: Synthetic peptide
HRSSLRR

SEQ ID NO: 5929 - protein, 7 aa, Artificial Sequence
  Description of Artificial Sequence: Synthetic peptide
DRSTRTK

SEQ ID NO: 5930 - protein, 7 aa, Artificial Sequence
  Description of Artificial Sequence: Synthetic peptide
RSDYLAK

SEQ ID NO: 5931 - protein, 7 aa, Artificial Sequence
  Description of Artificial Sequence: Synthetic peptide
QSSDLSR

SEQ ID NO: 5932 - protein, 7 aa, Artificial Sequence
  Description of Artificial Sequence: Synthetic peptide
QSTHRNA

SEQ ID NO: 5933 - protein, 7 aa, Artificial Sequence
  Description of Artificial Sequence: Synthetic peptide
RSADLTR

SEQ ID NO: 5934 - protein, 7 aa, Artificial Sequence
  Description of Artificial Sequence: Synthetic peptide
RSDDLTR

SEQ ID NO: 5935 - protein, 7 aa, Artificial Sequence
  Description of Artificial Sequence: Synthetic peptide
DRSNLSR

SEQ ID NO: 5936 - protein, 7 aa, Artificial Sequence
  Description of Artificial Sequence: Synthetic peptide
QSGNLAR

SEQ ID NO: 5937 - protein, 7 aa, Artificial Sequence
  Description of Artificial Sequence: Synthetic peptide
QSGHLAR

SEQ ID NO: 5938 - protein, 7 aa, Artificial Sequence
  Description of Artificial Sequence: Synthetic peptide
DRSHLAR

SEQ ID NO: 5939 - protein, 7 aa, Artificial Sequence
  Description of Artificial Sequence: Synthetic peptide
RSANLAR

SEQ ID NO: 5940 - protein, 7 aa, Artificial Sequence
  Description of Artificial Sequence: Synthetic peptide
QSANRTK

SEQ ID NO: 5941 - protein, 7 aa, Artificial Sequence
  Description of Artificial Sequence: Synthetic peptide
RSDHLTQ

SEQ ID NO: 5942 - protein, 7 aa, Artificial Sequence
  Description of Artificial Sequence: Synthetic peptide
QSSDLSR

SEQ ID NO: 5943 - protein, 7 aa, Artificial Sequence
  Description of Artificial Sequence: Synthetic peptide
RSDHLTQ

SEQ ID NO: 5944 - protein, 7 aa, Artificial Sequence
  Description of Artificial Sequence: Synthetic peptide
DRSALAR

SEQ ID NO: 5945 - protein, 7 aa, Artificial Sequence
  Description of Artificial Sequence: Synthetic peptide
RSDYLAK

SEQ ID NO: 5946 - protein, 7 aa, Artificial Sequence
  Description of Artificial Sequence: Synthetic peptide
QSGDLTR

SEQ ID NO: 5947 - protein, 7 aa, Artificial Sequence
  Description of Artificial Sequence: Synthetic peptide
RSDNLSQ

SEQ ID NO: 5948 - protein, 7 aa, Artificial Sequence
  Description of Artificial Sequence: Synthetic peptide
QRQHRKT

SEQ ID NO: 5949 - protein, 7 aa, Artificial Sequence
  Description of Artificial Sequence: Synthetic peptide
DQSNLRA

SEQ ID NO: 5950 - protein, 7 aa, Artificial Sequence
  Description of Artificial Sequence: Synthetic peptide
RPYTLRL

SEQ ID NO: 5951 - protein, 7 aa, Artificial Sequence
  Description of Artificial Sequence: Synthetic peptide
QSSNLAR

SEQ ID NO: 5952 - protein, 7 aa, Artificial Sequence
  Description of Artificial Sequence: Synthetic peptide
RSDNLTT

SEQ ID NO: 5953 - protein, 7 aa, Artificial Sequence
  Description of Artificial Sequence: Synthetic peptide
QSGHLAR

SEQ ID NO: 5954 - protein, 7 aa, Artificial Sequence
  Description of Artificial Sequence: Synthetic peptide
QRVALQA

SEQ ID NO: 5955 - protein, 7 aa, Artificial Sequence
  Description of Artificial Sequence: Synthetic peptide
ERGTLAR

SEQ ID NO: 5956 - protein, 7 aa, Artificial Sequence
  Description of Artificial Sequence: Synthetic peptide
QSGDLTR

SEQ ID NO: 5957 - protein, 7 aa, Artificial Sequence
  Description of Artificial Sequence: Synthetic peptide
RSDDLTR

SEQ ID NO: 5958 - protein, 7 aa, Artificial Sequence
  Description of Artificial Sequence: Synthetic peptide
QSSDLSR

SEQ ID NO: 5959 - protein, 7 aa, Artificial Sequence
  Description of Artificial Sequence: Synthetic peptide
HRSNLNK

SEQ ID NO: 5960 - protein, 7 aa, Artificial Sequence
  Description of Artificial Sequence: Synthetic peptide
RSADLTR

SEQ ID NO: 5961 - protein, 7 aa, Artificial Sequence
  Description of Artificial Sequence: Synthetic peptide
TNQNRIT

SEQ ID NO: 5962 - protein, 7 aa, Artificial Sequence
  Description of Artificial Sequence: Synthetic peptide
RSDALAR

SEQ ID NO: 5963 - protein, 7 aa, Artificial Sequence
  Description of Artificial Sequence: Synthetic peptide
DSSALIN

SEQ ID NO: 5964 - protein, 7 aa, Artificial Sequence
  Description of Artificial Sequence: Synthetic peptide
TSSNLSR

SEQ ID NO: 5965 - protein, 7 aa, Artificial Sequence
  Description of Artificial Sequence: Synthetic peptide
RSDHLSR

SEQ ID NO: 5966 - protein, 7 aa, Artificial Sequence
  Description of Artificial Sequence: Synthetic peptide
YGWYRHK

SEQ ID NO: 5967 - protein, 7 aa, Artificial Sequence
  Description of Artificial Sequence: Synthetic peptide
TSGHLSR

SEQ ID NO: 5968 - protein, 7 aa, Artificial Sequence
  Description of Artificial Sequence: Synthetic peptide
RSDNLTR

SEQ ID NO: 5969 - protein, 7 aa, Artificial Sequence
  Description of Artificial Sequence: Synthetic peptide
QSGHLAR

SEQ ID NO: 5970 - protein, 7 aa, Artificial Sequence
  Description of Artificial Sequence: Synthetic peptide
QRTNLVE

SEQ ID NO: 5971 - protein, 7 aa, Artificial Sequence
  Description of Artificial Sequence: Synthetic peptide
DRSTRTK

SEQ ID NO: 5972 - protein, 7 aa, Artificial Sequence
  Description of Artificial Sequence: Synthetic peptide
QSGNLHV

SEQ ID NO: 5973 - protein, 7 aa, Artificial Sequence
  Description of Artificial Sequence: Synthetic peptide
RSDHLTQ

SEQ ID NO: 5974 - protein, 7 aa, Artificial Sequence
  Description of Artificial Sequence: Synthetic peptide
RSDNLST

SEQ ID NO: 5975 - protein, 7 aa, Artificial Sequence
  Description of Artificial Sequence: Synthetic peptide
RSDNRTK

SEQ ID NO: 5976 - protein, 7 aa, Artificial Sequence
  Description of Artificial Sequence: Synthetic peptide
RSDNLAR

SEQ ID NO: 5977 - protein, 7 aa, Artificial Sequence
  Description of Artificial Sequence: Synthetic peptide
QKVNLMS

SEQ ID NO: 5978 - protein, 7 aa, Artificial Sequence
  Description of Artificial Sequence: Synthetic peptide
QSGALAR

SEQ ID NO: 5979 - protein, 7 aa, Artificial Sequence
  Description of Artificial Sequence: Synthetic peptide
QSGDLTR

SEQ ID NO: 5980 - protein, 7 aa, Artificial Sequence
  Description of Artificial Sequence: Synthetic peptide
TQGYLRK

SEQ ID NO: 5981 - protein, 7 aa, Artificial Sequence
  Description of Artificial Sequence: Synthetic peptide
RSDNLAR

SEQ ID NO: 5982 - protein, 7 aa, Artificial Sequence
  Description of Artificial Sequence: Synthetic peptide
DSSGLTH

SEQ ID NO: 5983 - protein, 7 aa, Artificial Sequence
  Description of Artificial Sequence: Synthetic peptide
RNDDRKK

SEQ ID NO: 5984 - protein, 7 aa, Artificial Sequence
  Description of Artificial Sequence: Synthetic peptide
DRSDLSR

SEQ ID NO: 5985 - protein, 7 aa, Artificial Sequence
  Description of Artificial Sequence: Synthetic peptide
RRDYLRT

SEQ ID NO: 5986 - protein, 7 aa, Artificial Sequence
  Description of Artificial Sequence: Synthetic peptide
RSDTLSE

SEQ ID NO: 5987 - protein, 7 aa, Artificial Sequence
  Description of Artificial Sequence: Synthetic peptide
NNRDRTK

SEQ ID NO: 5988 - protein, 7 aa, Artificial Sequence
  Description of Artificial Sequence: Synthetic peptide
RSDTLSE

SEQ ID NO: 5989 - protein, 7 aa, Artificial Sequence
  Description of Artificial Sequence: Synthetic peptide
QSGDLTR

SEQ ID NO: 5990 - protein, 7 aa, Artificial Sequence
  Description of Artificial Sequence: Synthetic peptide
QSSDLSR

SEQ ID NO: 5991 - protein, 7 aa, Artificial Sequence
  Description of Artificial Sequence: Synthetic peptide
QSTHRNA

SEQ ID NO: 5992 - protein, 7 aa, Artificial Sequence
  Description of Artificial Sequence: Synthetic peptide
RSDDLSK

SEQ ID NO: 5993 - protein, 7 aa, Artificial Sequence
  Description of Artificial Sequence: Synthetic peptide
RSDALAR

SEQ ID NO: 5994 - protein, 7 aa, Artificial Sequence
  Description of Artificial Sequence: Synthetic peptide
RSANLAR

SEQ ID NO: 5995 - protein, 7 aa, Artificial Sequence
  Description of Artificial Sequence: Synthetic peptide
RSDDLTR

SEQ ID NO: 5996 - protein, 7 aa, Artificial Sequence
  Description of Artificial Sequence: Synthetic peptide
RSDALST

SEQ ID NO: 5997 - protein, 7 aa, Artificial Sequence
  Description of Artificial Sequence: Synthetic peptide
DRSTRTK

SEQ ID NO: 5998 - protein, 7 aa, Artificial Sequence
  Description of Artificial Sequence: Synthetic peptide
QSGNLAR

SEQ ID NO: 5999 - protein, 7 aa, Artificial Sequence
  Description of Artificial Sequence: Synthetic peptide
QSTPLFA

SEQ ID NO: 6000 - protein, 7 aa, Artificial Sequence
  Description of Artificial Sequence: Synthetic peptide
QSGHLAR

SEQ ID NO: 6001 - protein, 7 aa, Artificial Sequence
  Description of Artificial Sequence: Synthetic peptide
ERIALVR

SEQ ID NO: 6002 - protein, 7 aa, Artificial Sequence
  Description of Artificial Sequence: Synthetic peptide
RSDHLSE

SEQ ID NO: 6003 - protein, 7 aa, Artificial Sequence
  Description of Artificial Sequence: Synthetic peptide
RSAHLSR

SEQ ID NO: 6004 - protein, 7 aa, Artificial Sequence
  Description of Artificial Sequence: Synthetic peptide
RSDNLSV

SEQ ID NO: 6005 - protein, 7 aa, Artificial Sequence
  Description of Artificial Sequence: Synthetic peptide
RSDTLSE

SEQ ID NO: 6006 - protein, 7 aa, Artificial Sequence
  Description of Artificial Sequence: Synthetic peptide
QSHNRTK

SEQ ID NO: 6007 - protein, 7 aa, Artificial Sequence
  Description of Artificial Sequence: Synthetic peptide
DRSHLTR

SEQ ID NO: 6008 - protein, 7 aa, Artificial Sequence
  Description of Artificial Sequence: Synthetic peptide
DRSALAR

SEQ ID NO: 6009 - protein, 7 aa, Artificial Sequence
  Description of Artificial Sequence: Synthetic peptide
TSGSLTR

SEQ ID NO: 6010 - protein, 7 aa, Artificial Sequence
  Description of Artificial Sequence: Synthetic peptide
LRHHLTR

SEQ ID NO: 6011 - protein, 7 aa, Artificial Sequence
  Description of Artificial Sequence: Synthetic peptide
QSYARTL

SEQ ID NO: 6012 - protein, 7 aa, Artificial Sequence
  Description of Artificial Sequence: Synthetic peptide
RSDNLST

SEQ ID NO: 6013 - protein, 7 aa, Artificial Sequence
  Description of Artificial Sequence: Synthetic peptide
RSDDLTR

SEQ ID NO: 6014 - protein, 7 aa, Artificial Sequence
  Description of Artificial Sequence: Synthetic peptide
RSAHLSR

SEQ ID NO: 6015 - protein, 7 aa, Artificial Sequence
  Description of Artificial Sequence: Synthetic peptide
RSDNLTR

SEQ ID NO: 6016 - protein, 7 aa, Artificial Sequence
  Description of Artificial Sequence: Synthetic peptide
RSDDLSK

SEQ ID NO: 6017 - protein, 7 aa, Artificial Sequence
  Description of Artificial Sequence: Synthetic peptide
DRSNRKT

SEQ ID NO: 6018 - protein, 7 aa, Artificial Sequence
  Description of Artificial Sequence: Synthetic peptide
DRSNLSR

SEQ ID NO: 6019 - protein, 7 aa, Artificial Sequence
  Description of Artificial Sequence: Synthetic peptide
QRTHLRD

SEQ ID NO: 6020 - protein, 7 aa, Artificial Sequence
  Description of Artificial Sequence: Synthetic peptide
QSGHLSR

SEQ ID NO: 6021 - protein, 7 aa, Artificial Sequence
  Description of Artificial Sequence: Synthetic peptide
QSSDLSR

SEQ ID NO: 6022 - protein, 7 aa, Artificial Sequence
  Description of Artificial Sequence: Synthetic peptide
QSGNRTT

SEQ ID NO: 6023 - protein, 7 aa, Artificial Sequence
  Description of Artificial Sequence: Synthetic peptide
DRSNLTR

SEQ ID NO: 6024 - protein, 7 aa, Artificial Sequence
  Description of Artificial Sequence: Synthetic peptide
QSGHLAR

SEQ ID NO: 6025 - protein, 7 aa, Artificial Sequence
  Description of Artificial Sequence: Synthetic peptide
QRTNLVE

SEQ ID NO: 6026 - protein, 7 aa, Artificial Sequence
  Description of Artificial Sequence: Synthetic peptide
QSGDLTR

SEQ ID NO: 6027 - protein, 7 aa, Artificial Sequence
  Description of Artificial Sequence: Synthetic peptide
RRDPLIN

SEQ ID NO: 6028 - protein, 7 aa, Artificial Sequence
  Description of Artificial Sequence: Synthetic peptide
QSGDLTR

SEQ ID NO: 6029 - protein, 7 aa, Artificial Sequence
  Description of Artificial Sequence: Synthetic peptide
RSDSLSR

SEQ ID NO: 6030 - protein, 7 aa, Artificial Sequence
  Description of Artificial Sequence: Synthetic peptide
DKSNRIK

SEQ ID NO: 6031 - protein, 7 aa, Artificial Sequence
  Description of Artificial Sequence: Synthetic peptide
QSSDLSR

SEQ ID NO: 6032 - protein, 7 aa, Artificial Sequence
  Description of Artificial Sequence: Synthetic peptide
QSGDLTR

SEQ ID NO: 6033 - protein, 7 aa, Artificial Sequence
  Description of Artificial Sequence: Synthetic peptide
QSSDLSR

SEQ ID NO: 6034 - protein, 7 aa, Artificial Sequence
  Description of Artificial Sequence: Synthetic peptide
TSGNLTR

SEQ ID NO: 6035 - protein, 7 aa, Artificial Sequence
  Description of Artificial Sequence: Synthetic peptide
QTSDRNK

SEQ ID NO: 6036 - protein, 7 aa, Artificial Sequence
  Description of Artificial Sequence: Synthetic peptide
QSGSLTR

SEQ ID NO: 6037 - protein, 7 aa, Artificial Sequence
  Description of Artificial Sequence: Synthetic peptide
RNDDRKK

SEQ ID NO: 6038 - protein, 7 aa, Artificial Sequence
  Description of Artificial Sequence: Synthetic peptide
RSDSLSA

SEQ ID NO: 6039 - protein, 7 aa, Artificial Sequence
  Description of Artificial Sequence: Synthetic peptide
QNAHRKT

SEQ ID NO: 6040 - protein, 7 aa, Artificial Sequence
  Description of Artificial Sequence: Synthetic peptide
QNAHRKT

SEQ ID NO: 6041 - protein, 7 aa, Artificial Sequence
  Description of Artificial Sequence: Synthetic peptide
QSGDLTR

SEQ ID NO: 6042 - protein, 7 aa, Artificial Sequence
  Description of Artificial Sequence: Synthetic peptide
DKGNLTK

SEQ ID NO: 6043 - protein, 7 aa, Artificial Sequence
  Description of Artificial Sequence: Synthetic peptide
QSSDLSR

SEQ ID NO: 6044 - protein, 7 aa, Artificial Sequence
  Description of Artificial Sequence: Synthetic peptide
QSAHRKN

SEQ ID NO: 6045 - protein, 7 aa, Artificial Sequence
  Description of Artificial Sequence: Synthetic peptide
QSSDLSR

SEQ ID NO: 6046 - protein, 7 aa, Artificial Sequence
  Description of Artificial Sequence: Synthetic peptide
RSDALSR

SEQ ID NO: 6047 - protein, 7 aa, Artificial Sequence
  Description of Artificial Sequence: Synthetic peptide
QSGSLTR

SEQ ID NO: 6048 - protein, 7 aa, Artificial Sequence
  Description of Artificial Sequence: Synthetic peptide
QSGSLTR

SEQ ID NO: 6049 - protein, 7 aa, Artificial Sequence
  Description of Artificial Sequence: Synthetic peptide
QSGSLTR

SEQ ID NO: 6050 - protein, 7 aa, Artificial Sequence
  Description of Artificial Sequence: Synthetic peptide
TSGHLSR

SEQ ID NO: 6051 - protein, 7 aa, Artificial Sequence
  Description of Artificial Sequence: Synthetic peptide
DRSHLAR

SEQ ID NO: 6052 - protein, 7 aa, Artificial Sequence
  Description of Artificial Sequence: Synthetic peptide
QSGDLTR

SEQ ID NO: 6053 - protein, 7 aa, Artificial Sequence
  Description of Artificial Sequence: Synthetic peptide
RSDHLSR

SEQ ID NO: 6054 - protein, 7 aa, Artificial Sequence
  Description of Artificial Sequence: Synthetic peptide
RSDHLST

SEQ ID NO: 6055 - protein, 7 aa, Artificial Sequence
  Description of Artificial Sequence: Synthetic peptide
RSDHLSR

SEQ ID NO: 6056 - protein, 7 aa, Artificial Sequence
  Description of Artificial Sequence: Synthetic peptide
QSSDLSR

SEQ ID NO: 6057 - protein, 7 aa, Artificial Sequence
  Description of Artificial Sequence: Synthetic peptide
RSDYLRK

SEQ ID NO: 6058 - protein, 7 aa, Artificial Sequence
  Description of Artificial Sequence: Synthetic peptide
QSGDLTR

SEQ ID NO: 6059 - protein, 7 aa, Artificial Sequence
  Description of Artificial Sequence: Synthetic peptide
LRQTLNS

SEQ ID NO: 6060 - protein, 7 aa, Artificial Sequence
  Description of Artificial Sequence: Synthetic peptide
QSGHLSR

SEQ ID NO: 6061 - protein, 7 aa, Artificial Sequence
  Description of Artificial Sequence: Synthetic peptide
RSDTLSV

SEQ ID NO: 6062 - protein, 7 aa, Artificial Sequence
  Description of Artificial Sequence: Synthetic peptide
DNSTRIK

SEQ ID NO: 6063 - protein, 7 aa, Artificial Sequence
  Description of Artificial Sequence: Synthetic peptide
RSDNLST

SEQ ID NO: 6064 - protein, 7 aa, Artificial Sequence
  Description of Artificial Sequence: Synthetic peptide
DNSNRIN

SEQ ID NO: 6065 - protein, 7 aa, Artificial Sequence
  Description of Artificial Sequence: Synthetic peptide
TSSNLSR

SEQ ID NO: 6066 - protein, 7 aa, Artificial Sequence
  Description of Artificial Sequence: Synthetic peptide
RSDVLSA

SEQ ID NO: 6067 - protein, 7 aa, Artificial Sequence
  Description of Artificial Sequence: Synthetic peptide
QNATRIN

SEQ ID NO: 6068 - protein, 7 aa, Artificial Sequence
  Description of Artificial Sequence: Synthetic peptide
RSDVLSE

SEQ ID NO: 6069 - protein, 7 aa, Artificial Sequence
  Description of Artificial Sequence: Synthetic peptide
QSGNLAR

SEQ ID NO: 6070 - protein, 7 aa, Artificial Sequence
  Description of Artificial Sequence: Synthetic peptide
RSDNLSV

SEQ ID NO: 6071 - protein, 7 aa, Artificial Sequence
  Description of Artificial Sequence: Synthetic peptide
QSADRTK

SEQ ID NO: 6072 - protein, 7 aa, Artificial Sequence
  Description of Artificial Sequence: Synthetic peptide
DRSNLTR

SEQ ID NO: 6073 - protein, 7 aa, Artificial Sequence
  Description of Artificial Sequence: Synthetic peptide
RSDNLSE

SEQ ID NO: 6074 - protein, 7 aa, Artificial Sequence
  Description of Artificial Sequence: Synthetic peptide
KRCNLRC

SEQ ID NO: 6075 - protein, 7 aa, Artificial Sequence
  Description of Artificial Sequence: Synthetic peptide
DRSNLSR

SEQ ID NO: 6076 - protein, 7 aa, Artificial Sequence
  Description of Artificial Sequence: Synthetic peptide
DSSARNT

SEQ ID NO: 6077 - protein, 7 aa, Artificial Sequence
  Description of Artificial Sequence: Synthetic peptide
TSGNLTR

SEQ ID NO: 6078 - protein, 7 aa, Artificial Sequence
  Description of Artificial Sequence: Synthetic peptide
DRSNLTR

SEQ ID NO: 6079 - protein, 7 aa, Artificial Sequence
  Description of Artificial Sequence: Synthetic peptide
DRSNLSR

SEQ ID NO: 6080 - protein, 7 aa, Artificial Sequence
  Description of Artificial Sequence: Synthetic peptide
QRSNLDS

SEQ ID NO: 6081 - protein, 7 aa, Artificial Sequence
  Description of Artificial Sequence: Synthetic peptide
QSGNLAR

SEQ ID NO: 6082 - protein, 7 aa, Artificial Sequence
  Description of Artificial Sequence: Synthetic peptide
QKVNRAG

SEQ ID NO: 6083 - protein, 7 aa, Artificial Sequence
  Description of Artificial Sequence: Synthetic peptide
RSDNLSV

SEQ ID NO: 6084 - protein, 7 aa, Artificial Sequence
  Description of Artificial Sequence: Synthetic peptide
QRNHRTT

SEQ ID NO: 6085 - protein, 7 aa, Artificial Sequence
  Description of Artificial Sequence: Synthetic peptide
QKATRIT

SEQ ID NO: 6086 - protein, 7 aa, Artificial Sequence
  Description of Artificial Sequence: Synthetic peptide
QSGALAR

SEQ ID NO: 6087 - protein, 7 aa, Artificial Sequence
  Description of Artificial Sequence: Synthetic peptide
LRHNLRA

SEQ ID NO: 6088 - protein, 7 aa, Artificial Sequence
  Description of Artificial Sequence: Synthetic peptide
DRSTRTK

SEQ ID NO: 6089 - protein, 7 aa, Artificial Sequence
  Description of Artificial Sequence: Synthetic peptide
HRSARKR

SEQ ID NO: 6090 - protein, 7 aa, Artificial Sequence
  Description of Artificial Sequence: Synthetic peptide
RSDHLSE

SEQ ID NO: 6091 - protein, 7 aa, Artificial Sequence
  Description of Artificial Sequence: Synthetic peptide
TSSDRTK

SEQ ID NO: 6092 - protein, 7 aa, Artificial Sequence
  Description of Artificial Sequence: Synthetic peptide
RSDSLSR

SEQ ID NO: 6093 - protein, 7 aa, Artificial Sequence
  Description of Artificial Sequence: Synthetic peptide
DKSNRIK

SEQ ID NO: 6094 - protein, 7 aa, Artificial Sequence
  Description of Artificial Sequence: Synthetic peptide
RSDDLTR

SEQ ID NO: 6095 - protein, 7 aa, Artificial Sequence
  Description of Artificial Sequence: Synthetic peptide
DRSHLTR

SEQ ID NO: 6096 - protein, 7 aa, Artificial Sequence
  Description of Artificial Sequence: Synthetic peptide
DRSNLTR

SEQ ID NO: 6097 - protein, 7 aa, Artificial Sequence
  Description of Artificial Sequence: Synthetic peptide
RSDNLST

SEQ ID NO: 6098 - protein, 7 aa, Artificial Sequence
  Description of Artificial Sequence: Synthetic peptide
RQWSLRI

SEQ ID NO: 6099 - protein, 7 aa, Artificial Sequence
  Description of Artificial Sequence: Synthetic peptide
TSGHLSR

SEQ ID NO: 6100 - protein, 7 aa, Artificial Sequence
  Description of Artificial Sequence: Synthetic peptide
QSSDLSR

SEQ ID NO: 6101 - protein, 7 aa, Artificial Sequence
  Description of Artificial Sequence: Synthetic peptide
RSDDLTR

SEQ ID NO: 6102 - protein, 7 aa, Artificial Sequence
  Description of Artificial Sequence: Synthetic peptide
RSANLAR

SEQ ID NO: 6103 - protein, 7 aa, Artificial Sequence
  Description of Artificial Sequence: Synthetic peptide
RLDNRTA

SEQ ID NO: 6104 - protein, 7 aa, Artificial Sequence
  Description of Artificial Sequence: Synthetic peptide
QSGHLAR

SEQ ID NO: 6105 - protein, 7 aa, Artificial Sequence
  Description of Artificial Sequence: Synthetic peptide
DSSNREA

SEQ ID NO: 6106 - protein, 7 aa, Artificial Sequence
  Description of Artificial Sequence: Synthetic peptide
RSDALSR

SEQ ID NO: 6107 - protein, 7 aa, Artificial Sequence
  Description of Artificial Sequence: Synthetic peptide
RSDNLTR

SEQ ID NO: 6108 - protein, 7 aa, Artificial Sequence
  Description of Artificial Sequence: Synthetic peptide
RSADLTR

SEQ ID NO: 6109 - protein, 7 aa, Artificial Sequence
  Description of Artificial Sequence: Synthetic peptide
RSDNLTR

SEQ ID NO: 6110 - protein, 7 aa, Artificial Sequence
  Description of Artificial Sequence: Synthetic peptide
RSDNLSV

SEQ ID NO: 6111 - protein, 7 aa, Artificial Sequence
  Description of Artificial Sequence: Synthetic peptide
RSDTRTE

SEQ ID NO: 6112 - protein, 7 aa, Artificial Sequence
  Description of Artificial Sequence: Synthetic peptide
TSGSLSR

SEQ ID NO: 6113 - protein, 7 aa, Artificial Sequence
  Description of Artificial Sequence: Synthetic peptide
QSGNLAR

SEQ ID NO: 6114 - protein, 7 aa, Artificial Sequence
  Description of Artificial Sequence: Synthetic peptide
RSADLTR

SEQ ID NO: 6115 - protein, 7 aa, Artificial Sequence
  Description of Artificial Sequence: Synthetic peptide
TSGSLSR

SEQ ID NO: 6116 - protein, 7 aa, Artificial Sequence
  Description of Artificial Sequence: Synthetic peptide
RSDHLTT

SEQ ID NO: 6117 - protein, 7 aa, Artificial Sequence
  Description of Artificial Sequence: Synthetic peptide
RSDDLTR

SEQ ID NO: 6118 - protein, 7 aa, Artificial Sequence
  Description of Artificial Sequence: Synthetic peptide
QRSTLSS

SEQ ID NO: 6119 - protein, 7 aa, Artificial Sequence
  Description of Artificial Sequence: Synthetic peptide
ERGTLAR

SEQ ID NO: 6120 - protein, 7 aa, Artificial Sequence
  Description of Artificial Sequence: Synthetic peptide
QSGHLSR

SEQ ID NO: 6121 - protein, 7 aa, Artificial Sequence
  Description of Artificial Sequence: Synthetic peptide
RSDHLSQ

SEQ ID NO: 6122 - protein, 7 aa, Artificial Sequence
  Description of Artificial Sequence: Synthetic peptide
DNASRIR

SEQ ID NO: 6123 - protein, 7 aa, Artificial Sequence
  Description of Artificial Sequence: Synthetic peptide
RSDNLST

SEQ ID NO: 6124 - protein, 7 aa, Artificial Sequence
  Description of Artificial Sequence: Synthetic peptide
AQWTRAC

SEQ ID NO: 6125 - protein, 7 aa, Artificial Sequence
  Description of Artificial Sequence: Synthetic peptide
RSDHLSE

SEQ ID NO: 6126 - protein, 7 aa, Artificial Sequence
  Description of Artificial Sequence: Synthetic peptide
DKANRTR

SEQ ID NO: 6127 - protein, 7 aa, Artificial Sequence
  Description of Artificial Sequence: Synthetic peptide
QSSDLSR

SEQ ID NO: 6128 - protein, 7 aa, Artificial Sequence
  Description of Artificial Sequence: Synthetic peptide
LRHNLRA

SEQ ID NO: 6129 - protein, 7 aa, Artificial Sequence
  Description of Artificial Sequence: Synthetic peptide
RSDTLST

SEQ ID NO: 6130 - protein, 7 aa, Artificial Sequence
  Description of Artificial Sequence: Synthetic peptide
DRSSRIK

SEQ ID NO: 6131 - protein, 7 aa, Artificial Sequence
  Description of Artificial Sequence: Synthetic peptide
QSGALAR

SEQ ID NO: 6132 - protein, 7 aa, Artificial Sequence
  Description of Artificial Sequence: Synthetic peptide
RSDNLTR

SEQ ID NO: 6133 - protein, 7 aa, Artificial Sequence
  Description of Artificial Sequence: Synthetic peptide
RSDNLST

SEQ ID NO: 6134 - protein, 7 aa, Artificial Sequence
  Description of Artificial Sequence: Synthetic peptide
DRSNLTR

SEQ ID NO: 6135 - protein, 7 aa, Artificial Sequence
  Description of Artificial Sequence: Synthetic peptide
DRSDLSR

SEQ ID NO: 6136 - protein, 7 aa, Artificial Sequence
  Description of Artificial Sequence: Synthetic peptide
DSSTRRR

SEQ ID NO: 6137 - protein, 7 aa, Artificial Sequence
  Description of Artificial Sequence: Synthetic peptide
DRSALAR

SEQ ID NO: 6138 - protein, 7 aa, Artificial Sequence
  Description of Artificial Sequence: Synthetic peptide
DRSALSR

SEQ ID NO: 6139 - protein, 7 aa, Artificial Sequence
  Description of Artificial Sequence: Synthetic peptide
DRSHLAR

SEQ ID NO: 6140 - protein, 7 aa, Artificial Sequence
  Description of Artificial Sequence: Synthetic peptide
RSDNLST

SEQ ID NO: 6141 - protein, 7 aa, Artificial Sequence
  Description of Artificial Sequence: Synthetic peptide
RSDARAN

SEQ ID NO: 6142 - protein, 7 aa, Artificial Sequence
  Description of Artificial Sequence: Synthetic peptide
RSDHLST

SEQ ID NO: 6143 - protein, 7 aa, Artificial Sequence
  Description of Artificial Sequence: Synthetic peptide
DSSNRIK

SEQ ID NO: 6144 - protein, 7 aa, Artificial Sequence
  Description of Artificial Sequence: Synthetic peptide
QSGALAR

SEQ ID NO: 6145 - protein, 7 aa, Artificial Sequence
  Description of Artificial Sequence: Synthetic peptide
RSDDLTR

SEQ ID NO: 6146 - protein, 7 aa, Artificial Sequence
  Description of Artificial Sequence: Synthetic peptide
QSGSLTR

SEQ ID NO: 6147 - protein, 7 aa, Artificial Sequence
  Description of Artificial Sequence: Synthetic peptide
DRSHLSR

SEQ ID NO: 6148 - protein, 7 aa, Artificial Sequence
  Description of Artificial Sequence: Synthetic peptide
DRSHLAR

SEQ ID NO: 6149 - protein, 7 aa, Artificial Sequence
  Description of Artificial Sequence: Synthetic peptide
QSSDLSR

SEQ ID NO: 6150 - protein, 7 aa, Artificial Sequence
  Description of Artificial Sequence: Synthetic peptide
QSGDLTR

SEQ ID NO: 6151 - protein, 7 aa, Artificial Sequence
  Description of Artificial Sequence: Synthetic peptide
RSDNLSE

SEQ ID NO: 6152 - protein, 7 aa, Artificial Sequence
  Description of Artificial Sequence: Synthetic peptide
HSNARKT

SEQ ID NO: 6153 - protein, 7 aa, Artificial Sequence
  Description of Artificial Sequence: Synthetic peptide
RSDALSV

SEQ ID NO: 6154 - protein, 7 aa, Artificial Sequence
  Description of Artificial Sequence: Synthetic peptide
DSSHRTR

SEQ ID NO: 6155 - protein, 7 aa, Artificial Sequence
  Description of Artificial Sequence: Synthetic peptide
QSGDLTR

SEQ ID NO: 6156 - protein, 7 aa, Artificial Sequence
  Description of Artificial Sequence: Synthetic peptide
ASHNLRT

SEQ ID NO: 6157 - protein, 7 aa, Artificial Sequence
  Description of Artificial Sequence: Synthetic peptide
RSDHLST

SEQ ID NO: 6158 - protein, 7 aa, Artificial Sequence
  Description of Artificial Sequence: Synthetic peptide
TSANLSR

SEQ ID NO: 6159 - protein, 7 aa, Artificial Sequence
  Description of Artificial Sequence: Synthetic peptide
DRSDLSR

SEQ ID NO: 6160 - protein, 7 aa, Artificial Sequence
  Description of Artificial Sequence: Synthetic peptide
DRSNLTR

SEQ ID NO: 6161 - protein, 7 aa, Artificial Sequence
  Description of Artificial Sequence: Synthetic peptide
RSDSLLR

SEQ ID NO: 6162 - protein, 7 aa, Artificial Sequence
  Description of Artificial Sequence: Synthetic peptide
RLDWLPM

SEQ ID NO: 6163 - protein, 7 aa, Artificial Sequence
  Description of Artificial Sequence: Synthetic peptide
RSADLTR

SEQ ID NO: 6164 - protein, 7 aa, Artificial Sequence
  Description of Artificial Sequence: Synthetic peptide
TSGNLTR

SEQ ID NO: 6165 - protein, 7 aa, Artificial Sequence
  Description of Artificial Sequence: Synthetic peptide
RSDNLSQ

SEQ ID NO: 6166 - protein, 7 aa, Artificial Sequence
  Description of Artificial Sequence: Synthetic peptide
DRSNRTK

SEQ ID NO: 6167 - protein, 7 aa, Artificial Sequence
  Description of Artificial Sequence: Synthetic peptide
DSSDRKK

SEQ ID NO: 6168 - protein, 7 aa, Artificial Sequence
  Description of Artificial Sequence: Synthetic peptide
RSDHLSE

SEQ ID NO: 6169 - protein, 7 aa, Artificial Sequence
  Description of Artificial Sequence: Synthetic peptide
QSASRKN

SEQ ID NO: 6170 - protein, 7 aa, Artificial Sequence
  Description of Artificial Sequence: Synthetic peptide
RSDVLST

SEQ ID NO: 6171 - protein, 7 aa, Artificial Sequence
  Description of Artificial Sequence: Synthetic peptide
STAALSY

SEQ ID NO: 6172 - protein, 7 aa, Artificial Sequence
  Description of Artificial Sequence: Synthetic peptide
QSANRTT

SEQ ID NO: 6173 - protein, 7 aa, Artificial Sequence
  Description of Artificial Sequence: Synthetic peptide
QNAHRKT

SEQ ID NO: 6174 - protein, 7 aa, Artificial Sequence
  Description of Artificial Sequence: Synthetic peptide
QSSDLSR

SEQ ID NO: 6175 - protein, 7 aa, Artificial Sequence
  Description of Artificial Sequence: Synthetic peptide
QRNHRTT

SEQ ID NO: 6176 - protein, 7 aa, Artificial Sequence
  Description of Artificial Sequence: Synthetic peptide
DRSNLTR

SEQ ID NO: 6177 - protein, 7 aa, Artificial Sequence
  Description of Artificial Sequence: Synthetic peptide
TSGNLTR

SEQ ID NO: 6178 - protein, 7 aa, Artificial Sequence
  Description of Artificial Sequence: Synthetic peptide
QSNQLRQ

SEQ ID NO: 6179 - protein, 7 aa, Artificial Sequence
  Description of Artificial Sequence: Synthetic peptide
RSDALTQ

SEQ ID NO: 6180 - DNA, 13 bp, Artificial Sequence
  Description of Artificial Sequence: Synthetic oligonucleotide
agcttcaatagta

SEQ ID NO: 6181 - DNA, 15 bp, Artificial Sequence
  Description of Artificial Sequence: Synthetic oligonucleotide
gtcttccggttggct

SEQ ID NO: 6182 - DNA, 12 bp, Artificial Sequence
  Description of Artificial Sequence: Synthetic oligonucleotide
gtcgatgcaccg

SEQ ID NO: 6183 - DNA, 18 bp, Artificial Sequence
  Description of Artificial Sequence: Synthetic oligonucleotide
ctaaggatggacgcagtg

SEQ ID NO: 6184 - DNA, 12 bp, Artificial Sequence
  Description of Artificial Sequence: Synthetic oligonucleotide
catgagagggat

SEQ ID NO: 6185 - DNA, 16 bp, Artificial Sequence
  Description of Artificial Sequence: Synthetic oligonucleotide
atgtcgtagaaaagaa

SEQ ID NO: 6186 - DNA, 19 bp, Artificial Sequence
  Description of Artificial Sequence: Synthetic oligonucleotide
catgttcgctgcggctgga

SEQ ID NO: 6187 - DNA, 12 bp, Artificial Sequence
  Description of Artificial Sequence: Synthetic oligonucleotide
agtccgctcggg

SEQ ID NO: 6188 - DNA, 18 bp, Artificial Sequence
  Description of Artificial Sequence: Synthetic oligonucleotide
gacgatctagcgagaagg

SEQ ID NO: 6189 - DNA, 19 bp, Artificial Sequence
  Description of Artificial Sequence: Synthetic oligonucleotide
atcgaagaacgcagcggat

SEQ ID NO: 6190 - DNA, 18 bp, Artificial Sequence
  Description of Artificial Sequence: Synthetic oligonucleotide
cacgcgccgggtgtctag

SEQ ID NO: 6191 - DNA, 19 bp, Artificial Sequence
  Description of Artificial Sequence: Synthetic oligonucleotide
gacgagcaccgccccaccg

SEQ ID NO: 6192 - DNA, 18 bp, Artificial Sequence
  Description of Artificial Sequence: Synthetic oligonucleotide
cgggtactgggaaaggag

SEQ ID NO: 6193 - DNA, 19 bp, Artificial Sequence
  Description of Artificial Sequence: Synthetic oligonucleotide
gagcgtcctgattgacatg

SEQ ID NO: 6194 - DNA, 19 bp, Artificial Sequence
  Description of Artificial Sequence: Synthetic oligonucleotide
acggtgcatcaagcttaag

SEQ ID NO: 6195 - DNA, 18 bp, Artificial Sequence
  Description of Artificial Sequence: Synthetic oligonucleotide
caagggacctagtgagct

SEQ ID NO: 6196 - DNA, 12 bp, Artificial Sequence
  Description of Artificial Sequence: Synthetic oligonucleotide
ggtgactaagct

SEQ ID NO: 6197 - DNA, 15 bp, Artificial Sequence
  Description of Artificial Sequence: Synthetic oligonucleotide
agataagctgcagac

SEQ ID NO: 6198 - DNA, 16 bp, Artificial Sequence
  Description of Artificial Sequence: Synthetic oligonucleotide
gagcaggcaggcaggc

SEQ ID NO: 6199 - DNA, 19 bp, Artificial Sequence
  Description of Artificial Sequence: Synthetic oligonucleotide
gtcgtcgtcgtgcgtggcc

SEQ ID NO: 6200 - DNA, 15 bp, Artificial Sequence
  Description of Artificial Sequence: Synthetic oligonucleotide
gtggcaacgggggct

SEQ ID NO: 6201 - DNA, 15 bp, Artificial Sequence
  Description of Artificial Sequence: Synthetic oligonucleotide
ggttcagcgggctag

SEQ ID NO: 6202 - DNA, 18 bp, Artificial Sequence
  Description of Artificial Sequence: Synthetic oligonucleotide
gcggtcttgccgggcgaa

SEQ ID NO: 6203 - DNA, 15 bp, Artificial Sequence
  Description of Artificial Sequence: Synthetic oligonucleotide
ctagaggcgcccatg

SEQ ID NO: 6204 - DNA, 19 bp, Artificial Sequence
  Description of Artificial Sequence: Synthetic oligonucleotide
acggacagccgagaaagca

SEQ ID NO: 6205 - DNA, 19 bp, Artificial Sequence
  Description of Artificial Sequence: Synthetic oligonucleotide
cgagatcgaggccagatcg

SEQ ID NO: 6206 - DNA, 18 bp, Artificial Sequence
  Description of Artificial Sequence: Synthetic oligonucleotide
ttgccatgggttattgag

SEQ ID NO: 6207 - DNA, 19 bp, Artificial Sequence
  Description of Artificial Sequence: Synthetic oligonucleotide
ggagcatggccaggtagtg

SEQ ID NO: 6208 - DNA, 19 bp, Artificial Sequence
  Description of Artificial Sequence: Synthetic oligonucleotide
ccagttccgacgagtggcg

SEQ ID NO: 6209 - DNA, 20 bp, Artificial Sequence
  Description of Artificial Sequence: Synthetic oligonucleotide
ggcctgggcgaacgccgccg

SEQ ID NO: 6210 - DNA, 15 bp, Artificial Sequence
  Description of Artificial Sequence: Synthetic oligonucleotide
agtgcaagggaagac

SEQ ID NO: 6211 - DNA, 18 bp, Artificial Sequence
  Description of Artificial Sequence: Synthetic oligonucleotide
aggagggatggagcagcg

SEQ ID NO: 6212 - DNA, 16 bp, Artificial Sequence
  Description of Artificial Sequence: Synthetic oligonucleotide
ggagataggagtagct

SEQ ID NO: 6213 - DNA, 15 bp, Artificial Sequence
  Description of Artificial Sequence: Synthetic oligonucleotide
gttgcgccctacgaa

SEQ ID NO: 6214 - DNA, 16 bp, Artificial Sequence
  Description of Artificial Sequence: Synthetic oligonucleotide
tcggttgaccgatggc

SEQ ID NO: 6215 - DNA, 19 bp, Artificial Sequence
  Description of Artificial Sequence: Synthetic oligonucleotide
aacgagccatatgcaagtt

SEQ ID NO: 6216 - DNA, 20 bp, Artificial Sequence
  Description of Artificial Sequence: Synthetic oligonucleotide
ggatggctccgaatgatatg

SEQ ID NO: 6217 - DNA, 15 bp, Artificial Sequence
  Description of Artificial Sequence: Synthetic oligonucleotide
gagggcgtcttgagg

SEQ ID NO: 6218 - DNA, 15 bp, Artificial Sequence
  Description of Artificial Sequence: Synthetic oligonucleotide
gtgttgctgtacgac

SEQ ID NO: 6219 - DNA, 16 bp, Artificial Sequence
  Description of Artificial Sequence: Synthetic oligonucleotide
gcagcgaacggctgta

SEQ ID NO: 6220 - DNA, 16 bp, Artificial Sequence
  Description of Artificial Sequence: Synthetic oligonucleotide
gggtaggggtgacgta

SEQ ID NO: 6221 - DNA, 16 bp, Artificial Sequence
  Description of Artificial Sequence: Synthetic oligonucleotide
gatcacgacatatcca

SEQ ID NO: 6222 - DNA, 16 bp, Artificial Sequence
  Description of Artificial Sequence: Synthetic oligonucleotide
tgggtgggtttgcgtg

SEQ ID NO: 6223 - DNA, 18 bp, Artificial Sequence
  Description of Artificial Sequence: Synthetic oligonucleotide
cccatgcaggtaaaggta

SEQ ID NO: 6224 - DNA, 18 bp, Artificial Sequence
  Description of Artificial Sequence: Synthetic oligonucleotide
ggactgggtgcctgtgtg

SEQ ID NO: 6225 - DNA, 12 bp, Artificial Sequence
  Description of Artificial Sequence: Synthetic oligonucleotide
cgtgggtacgaa

SEQ ID NO: 6226 - DNA, 19 bp, Artificial Sequence
  Description of Artificial Sequence: Synthetic oligonucleotide
cgtgctgtggtctggcgta

SEQ ID NO: 6227 - DNA, 19 bp, Artificial Sequence
  Description of Artificial Sequence: Synthetic oligonucleotide
tggggctatggccatgggg

SEQ ID NO: 6228 - DNA, 16 bp, Artificial Sequence
  Description of Artificial Sequence: Synthetic oligonucleotide
gcggtacgatagtgtt

SEQ ID NO: 6229 - DNA, 18 bp, Artificial Sequence
  Description of Artificial Sequence: Synthetic oligonucleotide
actcggggagtcggggtc

SEQ ID NO: 6230 - DNA, 12 bp, Artificial Sequence
  Description of Artificial Sequence: Synthetic oligonucleotide
gacggatcggag

SEQ ID NO: 6231 - DNA, 16 bp, Artificial Sequence
  Description of Artificial Sequence: Synthetic oligonucleotide
ggcggatgcatccgtt

SEQ ID NO: 6232 - DNA, 16 bp, Artificial Sequence
  Description of Artificial Sequence: Synthetic oligonucleotide
atagcggaccgatcgg

SEQ ID NO: 6233 - DNA, 19 bp, Artificial Sequence
  Description of Artificial Sequence: Synthetic oligonucleotide
atcccggccggtcgattcg

SEQ ID NO: 6234 - DNA, 19 bp, Artificial Sequence
  Description of Artificial Sequence: Synthetic oligonucleotide
cgtgcttgcggcaccgcag

SEQ ID NO: 6235 - DNA, 18 bp, Artificial Sequence
  Description of Artificial Sequence: Synthetic oligonucleotide
gccgctgcacccgttcat

SEQ ID NO: 6236 - DNA, 15 bp, Artificial Sequence
  Description of Artificial Sequence: Synthetic oligonucleotide
gaggacaggcgagct

SEQ ID NO: 6237 - DNA, 15 bp, Artificial Sequence
  Description of Artificial Sequence: Synthetic oligonucleotide
gaagacgtaggcgca

SEQ ID NO: 6238 - DNA, 18 bp, Artificial Sequence
  Description of Artificial Sequence: Synthetic oligonucleotide
cacaagatggtgatggtc

SEQ ID NO: 6239 - DNA, 18 bp, Artificial Sequence
  Description of Artificial Sequence: Synthetic oligonucleotide
catgtatgtatgtagtag

SEQ ID NO: 6240 - DNA, 12 bp, Artificial Sequence
  Description of Artificial Sequence: Synthetic oligonucleotide
tcggccatggga

SEQ ID NO: 6241 - DNA, 18 bp, Artificial Sequence
  Description of Artificial Sequence: Synthetic oligonucleotide
gcggccaaaaagcatgta

SEQ ID NO: 6242 - DNA, 18 bp, Artificial Sequence
  Description of Artificial Sequence: Synthetic oligonucleotide
ggtgccaaagccatgcag

SEQ ID NO: 6243 - DNA, 15 bp, Artificial Sequence
  Description of Artificial Sequence: Synthetic oligonucleotide
ggctggcgggcggcc

SEQ ID NO: 6244 - DNA, 16 bp, Artificial Sequence
  Description of Artificial Sequence: Synthetic oligonucleotide
ggagactcgataagaa

SEQ ID NO: 6245 - DNA, 16 bp, Artificial Sequence
  Description of Artificial Sequence: Synthetic oligonucleotide
gccatgtggggtagtt

SEQ ID NO: 6246 - DNA, 15 bp, Artificial Sequence
  Description of Artificial Sequence: Synthetic oligonucleotide
catggcatggcatcg

SEQ ID NO: 6247 - DNA, 19 bp, Artificial Sequence
  Description of Artificial Sequence: Synthetic oligonucleotide
cacatgcgcggcgcatgtc

SEQ ID NO: 6248 - DNA, 16 bp, Artificial Sequence
  Description of Artificial Sequence: Synthetic oligonucleotide
tagtaggctagtagct

SEQ ID NO: 6249 - DNA, 20 bp, Artificial Sequence
  Description of Artificial Sequence: Synthetic oligonucleotide
acgccgcggcggcttgcgct

SEQ ID NO: 6250 - DNA, 16 bp, Artificial Sequence
  Description of Artificial Sequence: Synthetic oligonucleotide
atctaggtgcaactag

SEQ ID NO: 6251 - DNA, 15 bp, Artificial Sequence
  Description of Artificial Sequence: Synthetic oligonucleotide
gtgaaacggatgtgt

SEQ ID NO: 6252 - DNA, 19 bp, Artificial Sequence
  Description of Artificial Sequence: Synthetic oligonucleotide
tcagaatatcatgatggcc

SEQ ID NO: 6253 - DNA, 16 bp, Artificial Sequence
  Description of Artificial Sequence: Synthetic oligonucleotide
tgcgagcgctgcatgg

SEQ ID NO: 6254 - DNA, 18 bp, Artificial Sequence
  Description of Artificial Sequence: Synthetic oligonucleotide
gctggaggggccaatgat

SEQ ID NO: 6255 - DNA, 12 bp, Artificial Sequence
  Description of Artificial Sequence: Synthetic oligonucleotide
tatccgatcccg

SEQ ID NO: 6256 - DNA, 18 bp, Artificial Sequence
  Description of Artificial Sequence: Synthetic oligonucleotide
tgtgtggatgacgaaacg

SEQ ID NO: 6257 - DNA, 15 bp, Artificial Sequence
  Description of Artificial Sequence: Synthetic oligonucleotide
ggagtaagaaatgac

SEQ ID NO: 6258 - DNA, 18 bp, Artificial Sequence
  Description of Artificial Sequence: Synthetic oligonucleotide
tccgcgttgctgtctgaa

SEQ ID NO: 6259 - DNA, 12 bp, Artificial Sequence
  Description of Artificial Sequence: Synthetic oligonucleotide
tatcagctcgag

SEQ ID NO: 6260 - DNA, 19 bp, Artificial Sequence
  Description of Artificial Sequence: Synthetic oligonucleotide
tagacctgttttgatggtt

SEQ ID NO: 6261 - DNA, 19 bp, Artificial Sequence
  Description of Artificial Sequence: Synthetic oligonucleotide
gaagacggcggcgagagct

SEQ ID NO: 6262 - DNA, 16 bp, Artificial Sequence
  Description of Artificial Sequence: Synthetic oligonucleotide
agggaagagaggagga

SEQ ID NO: 6263 - DNA, 15 bp, Artificial Sequence
  Description of Artificial Sequence: Synthetic oligonucleotide
gcacagatcagggct

SEQ ID NO: 6264 - DNA, 18 bp, Artificial Sequence
  Description of Artificial Sequence: Synthetic oligonucleotide
aaggatttgcacagacag

SEQ ID NO: 6265 - DNA, 15 bp, Artificial Sequence
  Description of Artificial Sequence: Synthetic oligonucleotide
gcggcagccatagga

SEQ ID NO: 6266 - DNA, 15 bp, Artificial Sequence
  Description of Artificial Sequence: Synthetic oligonucleotide
gtgcatgcgtatcca

SEQ ID NO: 6267 - DNA, 20 bp, Artificial Sequence
  Description of Artificial Sequence: Synthetic oligonucleotide
gagggtcttggggtgatatc

SEQ ID NO: 6268 - DNA, 15 bp, Artificial Sequence
  Description of Artificial Sequence: Synthetic oligonucleotide
aggaaagcccaagga

SEQ ID NO: 6269 - DNA, 15 bp, Artificial Sequence
  Description of Artificial Sequence: Synthetic oligonucleotide
gtacaagagtagtag

SEQ ID NO: 6270 - DNA, 15 bp, Artificial Sequence
  Description of Artificial Sequence: Synthetic oligonucleotide
tcgatcgagggcgca

SEQ ID NO: 6271 - DNA, 18 bp, Artificial Sequence
  Description of Artificial Sequence: Synthetic oligonucleotide
ccaccgtctccgtaggcc

SEQ ID NO: 6272 - DNA, 12 bp, Artificial Sequence
  Description of Artificial Sequence: Synthetic oligonucleotide
gtgtcgagagct

SEQ ID NO: 6273 - DNA, 19 bp, Artificial Sequence
  Description of Artificial Sequence: Synthetic oligonucleotide
atagaaaaccatggcggag

SEQ ID NO: 6274 - DNA, 16 bp, Artificial Sequence
  Description of Artificial Sequence: Synthetic oligonucleotide
aaggggcggcaacgga

SEQ ID NO: 6275 - DNA, 15 bp, Artificial Sequence
  Description of Artificial Sequence: Synthetic oligonucleotide
gttgtcggataaccg

SEQ ID NO: 6276 - DNA, 18 bp, Artificial Sequence
  Description of Artificial Sequence: Synthetic oligonucleotide
gagggggagtagctaggt

SEQ ID NO: 6277 - DNA, 16 bp, Artificial Sequence
  Description of Artificial Sequence: Synthetic oligonucleotide
ggacgagaccaaatcg

SEQ ID NO: 6278 - DNA, 15 bp, Artificial Sequence
  Description of Artificial Sequence: Synthetic oligonucleotide
caaggagacaaagct

SEQ ID NO: 6279 - DNA, 16 bp, Artificial Sequence
  Description of Artificial Sequence: Synthetic oligonucleotide
tacgtggcaattggca

SEQ ID NO: 6280 - DNA, 15 bp, Artificial Sequence
  Description of Artificial Sequence: Synthetic oligonucleotide
tcagatgctgcagct

SEQ ID NO: 6281 - DNA, 16 bp, Artificial Sequence
  Description of Artificial Sequence: Synthetic oligonucleotide
agaagatcgatcggta

SEQ ID NO: 6282 - DNA, 15 bp, Artificial Sequence
  Description of Artificial Sequence: Synthetic oligonucleotide
gcttgagctcacgca

SEQ ID NO: 6283 - DNA, 19 bp, Artificial Sequence
  Description of Artificial Sequence: Synthetic oligonucleotide
cactactactactaccgcc

SEQ ID NO: 6284 - DNA, 12 bp, Artificial Sequence
  Description of Artificial Sequence: Synthetic oligonucleotide
gggtggggggca

SEQ ID NO: 6285 - DNA, 16 bp, Artificial Sequence
  Description of Artificial Sequence: Synthetic oligonucleotide
ggacctacaataggca

SEQ ID NO: 6286 - DNA, 15 bp, Artificial Sequence
  Description of Artificial Sequence: Synthetic oligonucleotide
gatcacaagaccaag

SEQ ID NO: 6287 - DNA, 15 bp, Artificial Sequence
  Description of Artificial Sequence: Synthetic oligonucleotide
cattgtcagttcctt

SEQ ID NO: 6288 - DNA, 12 bp, Artificial Sequence
  Description of Artificial Sequence: Synthetic oligonucleotide
cagcaggactct

SEQ ID NO: 6289 - DNA, 15 bp, Artificial Sequence
  Description of Artificial Sequence: Synthetic oligonucleotide
aagacagacgatgtc

SEQ ID NO: 6290 - DNA, 15 bp, Artificial Sequence
  Description of Artificial Sequence: Synthetic oligonucleotide
acaaaaaagcaagaa

SEQ ID NO: 6291 - DNA, 19 bp, Artificial Sequence
  Description of Artificial Sequence: Synthetic oligonucleotide
tcacggtgttacccatgta

SEQ ID NO: 6292 - DNA, 16 bp, Artificial Sequence
  Description of Artificial Sequence: Synthetic oligonucleotide
gacggatgcgtacgtg

SEQ ID NO: 6293 - DNA, 15 bp, Artificial Sequence
  Description of Artificial Sequence: Synthetic oligonucleotide
gttgttattcaaaca

SEQ ID NO: 6294 - DNA, 15 bp, Artificial Sequence
  Description of Artificial Sequence: Synthetic oligonucleotide
cacaagtaatgtgga

SEQ ID NO: 6295 - DNA, 15 bp, Artificial Sequence
  Description of Artificial Sequence: Synthetic oligonucleotide
gcggctggtttgcag

SEQ ID NO: 6296 - DNA, 12 bp, Artificial Sequence
  Description of Artificial Sequence: Synthetic oligonucleotide
cacggacaggag

SEQ ID NO: 6297 - DNA, 12 bp, Artificial Sequence
  Description of Artificial Sequence: Synthetic oligonucleotide
gaggcggaggtg

SEQ ID NO: 6298 - DNA, 18 bp, Artificial Sequence
  Description of Artificial Sequence: Synthetic oligonucleotide
agggcggaagttacggag

SEQ ID NO: 6299 - DNA, 19 bp, Artificial Sequence
  Description of Artificial Sequence: Synthetic oligonucleotide
ggagcccccagcgtgggtt

SEQ ID NO: 6300 - DNA, 19 bp, Artificial Sequence
  Description of Artificial Sequence: Synthetic oligonucleotide
gaccggtcagtaggtcaag

SEQ ID NO: 6301 - DNA, 13 bp, Artificial Sequence
  Description of Artificial Sequence: Synthetic oligonucleotide
ttcacgtcatgct

SEQ ID NO: 6302 - DNA, 18 bp, Artificial Sequence
  Description of Artificial Sequence: Synthetic oligonucleotide
gccgacgactaggaggta

SEQ ID NO: 6303 - DNA, 15 bp, Artificial Sequence
  Description of Artificial Sequence: Synthetic oligonucleotide
ctgtagggcgtcgtc

SEQ ID NO: 6304 - DNA, 16 bp, Artificial Sequence
  Description of Artificial Sequence: Synthetic oligonucleotide
gtagcggtactactgg

SEQ ID NO: 6305 - DNA, 18 bp, Artificial Sequence
  Description of Artificial Sequence: Synthetic oligonucleotide
atccaggcagctggcggc

SEQ ID NO: 6306 - DNA, 18 bp, Artificial Sequence
  Description of Artificial Sequence: Synthetic oligonucleotide
gattggaatgcaggcccg

SEQ ID NO: 6307 - DNA, 20 bp, Artificial Sequence
  Description of Artificial Sequence: Synthetic oligonucleotide
gatgcgtctggtgtgacgac

SEQ ID NO: 6308 - DNA, 15 bp, Artificial Sequence
  Description of Artificial Sequence: Synthetic oligonucleotide
acacagtcctactag

SEQ ID NO: 6309 - DNA, 15 bp, Artificial Sequence
  Description of Artificial Sequence: Synthetic oligonucleotide
gctcgaaaacttatg

SEQ ID NO: 6310 - DNA, 15 bp, Artificial Sequence
  Description of Artificial Sequence: Synthetic oligonucleotide
atgaaagatgaccga

SEQ ID NO: 6311 - DNA, 22 bp, Artificial Sequence
  Description of Artificial Sequence: Synthetic primer
caaccagaaacgtcctgcactg

SEQ ID NO: 6312 - DNA, 24 bp, Artificial Sequence
  Description of Artificial Sequence: Synthetic primer
ccacgatcgacattgatctggcta

SEQ ID NO: 6313 - DNA, 21 bp, Artificial Sequence
  Description of Artificial Sequence: Synthetic primer
aaatccaagccacgtacgcac

SEQ ID NO: 6314 - DNA, 24 bp, Artificial Sequence
  Description of Artificial Sequence: Synthetic primer
gtttcatcaagccttacggtcacc

SEQ ID NO: 6315 - DNA, 21 bp, Artificial Sequence
  Description of Artificial Sequence: Synthetic primer
acaccaattgcccatttggca

SEQ ID NO: 6316 - DNA, 22 bp, Artificial Sequence
  Description of Artificial Sequence: Synthetic primer
gctggcgatgagcgaaatgtag

SEQ ID NO: 6317 - DNA, 21 bp, Artificial Sequence
  Description of Artificial Sequence: Synthetic primer
ttggttagcagcacggatgga

SEQ ID NO: 6318 - DNA, 21 bp, Artificial Sequence
  Description of Artificial Sequence: Synthetic primer
cagcaacgtcggttcgagatg

SEQ ID NO: 6319 - DNA, 23 bp, Artificial Sequence
  Description of Artificial Sequence: Synthetic primer
atgccactttcgaagagaggacg

SEQ ID NO: 6320 - DNA, 21 bp, Artificial Sequence
  Description of Artificial Sequence: Synthetic primer
catctccaacgtcatcggcac

SEQ ID NO: 6321 - DNA, 23 bp, Artificial Sequence
  Description of Artificial Sequence: Synthetic primer
gggaaacagattcgtcagcttgc

SEQ ID NO: 6322 - DNA, 21 bp, Artificial Sequence
  Description of Artificial Sequence: Synthetic primer
gcctatccagtggcggataca

SEQ ID NO: 6323 - DNA, 22 bp, Artificial Sequence
  Description of Artificial Sequence: Synthetic primer
cttgctctacaactctgcccca

SEQ ID NO: 6324 - DNA, 24 bp, Artificial Sequence
  Description of Artificial Sequence: Synthetic primer
ccacgatcgacattgatctggcta

SEQ ID NO: 6325 - DNA, 21 bp, Artificial Sequence
  Description of Artificial Sequence: Synthetic primer
agtcggtacctgcaagctacg

SEQ ID NO: 6326 - DNA, 24 bp, Artificial Sequence
  Description of Artificial Sequence: Synthetic primer
gtttcatcaagccttacggtcacc

SEQ ID NO: 6327 - DNA, 21 bp, Artificial Sequence
  Description of Artificial Sequence: Synthetic primer
tggatttgaggccaactgcac

SEQ ID NO: 6328 - DNA, 22 bp, Artificial Sequence
  Description of Artificial Sequence: Synthetic primer
gctggcgatgagcgaaatgtag

SEQ ID NO: 6329 - DNA, 22 bp, Artificial Sequence
  Description of Artificial Sequence: Synthetic primer
tctgcattgttgggatcgacca

SEQ ID NO: 6330 - DNA, 21 bp, Artificial Sequence
  Description of Artificial Sequence: Synthetic primer
cagcaacgtcggttcgagatg

SEQ ID NO: 6331 - DNA, 21 bp, Artificial Sequence
  Description of Artificial Sequence: Synthetic primer
acgatcgcaggttatcctcgc

SEQ ID NO: 6332 - DNA, 21 bp, Artificial Sequence
  Description of Artificial Sequence: Synthetic primer
cttgtcggttgctgtgtggac

SEQ ID NO: 6333 - DNA, 20 bp, Artificial Sequence
  Description of Artificial Sequence: Synthetic primer
aacacggatggcctgcaatg

SEQ ID NO: 6334 - DNA, 20 bp, Artificial Sequence
  Description of Artificial Sequence: Synthetic primer
gcatgggcgtacgtcacttg

SEQ ID NO: 6335 - DNA, 21 bp, Artificial Sequence
  Description of Artificial Sequence: Synthetic primer
acccagaatctctggttccgt

SEQ ID NO: 6336 - DNA, 20 bp, Artificial Sequence
  Description of Artificial Sequence: Synthetic primer
caggaagctctgcatctgcg

SEQ ID NO: 6337 - DNA, 25 bp, Artificial Sequence
  Description of Artificial Sequence: Synthetic primer
agtctttgatgtaaacgtcttgcct

SEQ ID NO: 6338 - DNA, 20 bp, Artificial Sequence
  Description of Artificial Sequence: Synthetic primer
gcatggaaacaccaggtcga

SEQ ID NO: 6339 - DNA, 22 bp, Artificial Sequence
  Description of Artificial Sequence: Synthetic primer
gcagcgaataggaatgcgagac

SEQ ID NO: 6340 - DNA, 22 bp, Artificial Sequence
  Description of Artificial Sequence: Synthetic primer
taaccttgtttcgctgactccc

SEQ ID NO: 6341 - DNA, 23 bp, Artificial Sequence
  Description of Artificial Sequence: Synthetic primer
cttcttctacctacacgcaccag

SEQ ID NO: 6342 - DNA, 21 bp, Artificial Sequence
  Description of Artificial Sequence: Synthetic primer
gatccgtttcctcactctcgc

SEQ ID NO: 6343 - DNA, 21 bp, Artificial Sequence
  Description of Artificial Sequence: Synthetic primer
aggtgaatcttccgtggctgt

SEQ ID NO: 6344 - DNA, 24 bp, Artificial Sequence
  Description of Artificial Sequence: Synthetic primer
ccataatcagtgtgactggtggct

SEQ ID NO: 6345 - DNA, 21 bp, Artificial Sequence
  Description of Artificial Sequence: Synthetic primer
cggatctaaggtgccctgtct

SEQ ID NO: 6346 - DNA, 23 bp, Artificial Sequence
  Description of Artificial Sequence: Synthetic primer
gtctagctcatggaagtgggagg

SEQ ID NO: 6347 - DNA, 22 bp, Artificial Sequence
  Description of Artificial Sequence: Synthetic primer
gacttctaagccccaaggccta

SEQ ID NO: 6348 - DNA, 23 bp, Artificial Sequence
  Description of Artificial Sequence: Synthetic primer
agatcttttggctccctctcacc

SEQ ID NO: 6349 - DNA, 21 bp, Artificial Sequence
  Description of Artificial Sequence: Synthetic primer
gtgcttcgagggctcaaggta

SEQ ID NO: 6350 - DNA, 20 bp, Artificial Sequence
  Description of Artificial Sequence: Synthetic primer
attgctcaccccatcccctt

SEQ ID NO: 6351 - DNA, 21 bp, Artificial Sequence
  Description of Artificial Sequence: Synthetic primer
ggctatgacccggacactacc

SEQ ID NO: 6352 - DNA, 24 bp, Artificial Sequence
  Description of Artificial Sequence: Synthetic primer
cagttgggcgtcaagttagttcag

SEQ ID NO: 6353 - DNA, 23 bp, Artificial Sequence
  Description of Artificial Sequence: Synthetic primer
aagtccacaaggatctgaccacg

SEQ ID NO: 6354 - DNA, 24 bp, Artificial Sequence
  Description of Artificial Sequence: Synthetic primer
tgaaactttggttcagtctgctcg

SEQ ID NO: 6355 - DNA, 21 bp, Artificial Sequence
  Description of Artificial Sequence: Synthetic primer
tatgtccaagccacgagaagc

SEQ ID NO: 6356 - DNA, 22 bp, Artificial Sequence
  Description of Artificial Sequence: Synthetic primer
actgcaggtactactggtacgc

SEQ ID NO: 6357 - DNA, 22 bp, Artificial Sequence
  Description of Artificial Sequence: Synthetic primer
gctacagtatagcaggagcagc

SEQ ID NO: 6358 - DNA, 20 bp, Artificial Sequence
  Description of Artificial Sequence: Synthetic primer
gtcctactatacgctgccgc

SEQ ID NO: 6359 - DNA, 21 bp, Artificial Sequence
  Description of Artificial Sequence: Synthetic primer
caatccttctgagctgcaccg

SEQ ID NO: 6360 - DNA, 21 bp, Artificial Sequence
  Description of Artificial Sequence: Synthetic primer
ggtgtcaatgacctcacgagc

SEQ ID NO: 6361 - DNA, 21 bp, Artificial Sequence
  Description of Artificial Sequence: Synthetic primer
ccgtaccaaacaggcaagcag

SEQ ID NO: 6362 - DNA, 24 bp, Artificial Sequence
  Description of Artificial Sequence: Synthetic primer
gatcgcccatatgcttggattcac

SEQ ID NO: 6363 - DNA, 21 bp, Artificial Sequence
  Description of Artificial Sequence: Synthetic primer
ggattaggacggctgactggt

SEQ ID NO: 6364 - DNA, 21 bp, Artificial Sequence
  Description of Artificial Sequence: Synthetic primer
gttgctttgtttgcgtgctcc

SEQ ID NO: 6365 - DNA, 24 bp, Artificial Sequence
  Description of Artificial Sequence: Synthetic primer
ttaaagtgctagctgactgaccga

SEQ ID NO: 6366 - DNA, 20 bp, Artificial Sequence
  Description of Artificial Sequence: Synthetic primer
ggcccatgccttaggttgac

SEQ ID NO: 6367 - DNA, 21 bp, Artificial Sequence
  Description of Artificial Sequence: Synthetic primer
actgagactgggagtctggga

SEQ ID NO: 6368 - DNA, 21 bp, Artificial Sequence
  Description of Artificial Sequence: Synthetic primer
cgccgtccgactgttattacc

SEQ ID NO: 6369 - DNA, 22 bp, Artificial Sequence
  Description of Artificial Sequence: Synthetic primer
cttcggccttggattggatcac

SEQ ID NO: 6370 - DNA, 23 bp, Artificial Sequence
  Description of Artificial Sequence: Synthetic primer
acaacgcagatccctagaatcca

SEQ ID NO: 6371 - DNA, 24 bp, Artificial Sequence
  Description of Artificial Sequence: Synthetic primer
gggatctcttgtcaccaaatcagc

SEQ ID NO: 6372 - DNA, 24 bp, Artificial Sequence
  Description of Artificial Sequence: Synthetic primer
ttgacagtgagacatgggagtacc

SEQ ID NO: 6373 - DNA, 21 bp, Artificial Sequence
  Description of Artificial Sequence: Synthetic primer
tgcctgcattgcatcgatctg

SEQ ID NO: 6374 - DNA, 21 bp, Artificial Sequence
  Description of Artificial Sequence: Synthetic primer
agtacccactgtcactgcacg

SEQ ID NO: 6375 - DNA, 24 bp, Artificial Sequence
  Description of Artificial Sequence: Synthetic primer
atcttcaccaagtatcccacacct

SEQ ID NO: 6376 - DNA, 24 bp, Artificial Sequence
  Description of Artificial Sequence: Synthetic primer
gctgtgttagtatcgtcgaaggct

SEQ ID NO: 6377 - DNA, 24 bp, Artificial Sequence
  Description of Artificial Sequence: Synthetic primer
tcaaacctcacctgatgtatcgct

SEQ ID NO: 6378 - DNA, 25 bp, Artificial Sequence
  Description of Artificial Sequence: Synthetic primer
cgaacctccaatttatcggcaatcg

SEQ ID NO: 6379 - DNA, 21 bp, Artificial Sequence
  Description of Artificial Sequence: Synthetic primer
aagtccctagagccctcatgc

SEQ ID NO: 6380 - DNA, 22 bp, Artificial Sequence
  Description of Artificial Sequence: Synthetic primer
gagagttaggagggagcatggc

SEQ ID NO: 6381 - DNA, 22 bp, Artificial Sequence
  Description of Artificial Sequence: Synthetic primer
gtgtccgagataggtcgtgtcc

SEQ ID NO: 6382 - DNA, 22 bp, Artificial Sequence
  Description of Artificial Sequence: Synthetic primer
ttgaacttgggcatgagtggga

SEQ ID NO: 6383 - DNA, 21 bp, Artificial Sequence
  Description of Artificial Sequence: Synthetic primer
gtcggctgtgcgttatgagac

SEQ ID NO: 6384 - DNA, 24 bp, Artificial Sequence
  Description of Artificial Sequence: Synthetic primer
gattaatcggttatcggtggacgc

SEQ ID NO: 6385 - DNA, 21 bp, Artificial Sequence
  Description of Artificial Sequence: Synthetic primer
acggacagatcacagatcggg

SEQ ID NO: 6386 - DNA, 23 bp, Artificial Sequence
  Description of Artificial Sequence: Synthetic primer
ccttaatccggtttggtgaaccc

SEQ ID NO: 6387 - DNA, 21 bp, Artificial Sequence
  Description of Artificial Sequence: Synthetic primer
gcttacaccgatgcaggggta

SEQ ID NO: 6388 - DNA, 22 bp, Artificial Sequence
  Description of Artificial Sequence: Synthetic primer
ggttgacatcggaattcgtgcc

SEQ ID NO: 6389 - DNA, 22 bp, Artificial Sequence
  Description of Artificial Sequence: Synthetic primer
tgaaagagagcggcccaactac

SEQ ID NO: 6390 - DNA, 21 bp, Artificial Sequence
  Description of Artificial Sequence: Synthetic primer
ttaatgctggcctctcctgca

SEQ ID NO: 6391 - DNA, 21 bp, Artificial Sequence
  Description of Artificial Sequence: Synthetic primer
atgaagagcaccagctacccc

SEQ ID NO: 6392 - DNA, 21 bp, Artificial Sequence
  Description of Artificial Sequence: Synthetic primer
ggaagatggaaccacatgccc

SEQ ID NO: 6393 - DNA, 21 bp, Artificial Sequence
  Description of Artificial Sequence: Synthetic primer
ggctacaaaacccaagagggg

SEQ ID NO: 6394 - DNA, 22 bp, Artificial Sequence
  Description of Artificial Sequence: Synthetic primer
ccctttcatgcaacgatcaggc

SEQ ID NO: 6395 - DNA, 23 bp, Artificial Sequence
  Description of Artificial Sequence: Synthetic primer
tgttcagttggtaagtcgtcgct

SEQ ID NO: 6396 - DNA, 23 bp, Artificial Sequence
  Description of Artificial Sequence: Synthetic primer
gttcttggagagtgattgtcggc

SEQ ID NO: 6397 - DNA, 22 bp, Artificial Sequence
  Description of Artificial Sequence: Synthetic primer
cttcacctcaagggaagcaagc

SEQ ID NO: 6398 - DNA, 23 bp, Artificial Sequence
  Description of Artificial Sequence: Synthetic primer
ggtgaaactgagctgggaattgg

SEQ ID NO: 6399 - DNA, 25 bp, Artificial Sequence
  Description of Artificial Sequence: Synthetic primer
gatccacaaccacattcaacaaggt

SEQ ID NO: 6400 - DNA, 25 bp, Artificial Sequence
  Description of Artificial Sequence: Synthetic primer
tgatcaaactagaggcctgatgacg

SEQ ID NO: 6401 - DNA, 25 bp, Artificial Sequence
  Description of Artificial Sequence: Synthetic primer
ggacaaatgacatgtaacccactcc

SEQ ID NO: 6402 - DNA, 21 bp, Artificial Sequence
  Description of Artificial Sequence: Synthetic primer
atgacgacagcgtgtttgtgg

SEQ ID NO: 6403 - DNA, 22 bp, Artificial Sequence
  Description of Artificial Sequence: Synthetic primer
agctccacttccagtagtcctg

SEQ ID NO: 6404 - DNA, 21 bp, Artificial Sequence
  Description of Artificial Sequence: Synthetic primer
cggatagcgtccacaaacgag

SEQ ID NO: 6405 - DNA, 21 bp, Artificial Sequence
  Description of Artificial Sequence: Synthetic primer
aatcatgcggctgtcgaaagg

SEQ ID NO: 6406 - DNA, 22 bp, Artificial Sequence
  Description of Artificial Sequence: Synthetic primer
gcgataagaaagcatcctgcgg

SEQ ID NO: 6407 - DNA, 22 bp, Artificial Sequence
  Description of Artificial Sequence: Synthetic primer
actgtaccaccgaaagacgacc

SEQ ID NO: 6408 - DNA, 24 bp, Artificial Sequence
  Description of Artificial Sequence: Synthetic primer
cccgtctcactgtggatctatgtc

SEQ ID NO: 6409 - DNA, 22 bp, Artificial Sequence
  Description of Artificial Sequence: Synthetic primer
aaagacgaccaaacagtcctgc

SEQ ID NO: 6410 - DNA, 22 bp, Artificial Sequence
  Description of Artificial Sequence: Synthetic primer
gagtcaacgtgtcagtgtcacc

SEQ ID NO: 6411 - DNA, 22 bp, Artificial Sequence
  Description of Artificial Sequence: Synthetic primer
aggtgtagtcctgctctgtctg

SEQ ID NO: 6412 - DNA, 24 bp, Artificial Sequence
  Description of Artificial Sequence: Synthetic primer
aactgaagacactgacgacatcca

SEQ ID NO: 6413 - DNA, 21 bp, Artificial Sequence
  Description of Artificial Sequence: Synthetic primer
tagggcgctaggcatgtactc

SEQ ID NO: 6414 - DNA, 23 bp, Artificial Sequence
  Description of Artificial Sequence: Synthetic primer
gtggccttctaggtacactaggg

SEQ ID NO: 6415 - DNA, 22 bp, Artificial Sequence
  Description of Artificial Sequence: Synthetic primer
gcaaccaactttgtcggatgct

SEQ ID NO: 6416 - DNA, 21 bp, Artificial Sequence
  Description of Artificial Sequence: Synthetic primer
aaagctcacctcacagcacga

SEQ ID NO: 6417 - DNA, 25 bp, Artificial Sequence
  Description of Artificial Sequence: Synthetic primer
tcatagatttcgcgtggttgaactg

SEQ ID NO: 6418 - DNA, 22 bp, Artificial Sequence
  Description of Artificial Sequence: Synthetic primer
actctgcagccatgaattccac

SEQ ID NO: 6419 - DNA, 22 bp, Artificial Sequence
  Description of Artificial Sequence: Synthetic primer
gagaaaccgagggatcggaaca

SEQ ID NO: 6420 - DNA, 22 bp, Artificial Sequence
  Description of Artificial Sequence: Synthetic primer
acatgtacgtgtgcgagagtcg

SEQ ID NO: 6421 - DNA, 22 bp, Artificial Sequence
  Description of Artificial Sequence: Synthetic primer
agtacgactggaatccaacgcg

SEQ ID NO: 6422 - DNA, 21 bp, Artificial Sequence
  Description of Artificial Sequence: Synthetic primer
ctctccctagctcgacgcttg

SEQ ID NO: 6423 - DNA, 21 bp, Artificial Sequence
  Description of Artificial Sequence: Synthetic primer
gtagcactgcaccgttcatgc

SEQ ID NO: 6424 - DNA, 21 bp, Artificial Sequence
  Description of Artificial Sequence: Synthetic primer
actctccttccctcgacggta

SEQ ID NO: 6425 - DNA, 22 bp, Artificial Sequence
  Description of Artificial Sequence: Synthetic primer
aggagatgaaggctttgtcccc

SEQ ID NO: 6426 - DNA, 21 bp, Artificial Sequence
  Description of Artificial Sequence: Synthetic primer
gcaaacctgcatggttgatgc

SEQ ID NO: 6427 - DNA, 21 bp, Artificial Sequence
  Description of Artificial Sequence: Synthetic primer
ttgggtttgtgcaccacactc

SEQ ID NO: 6428 - DNA, 21 bp, Artificial Sequence
  Description of Artificial Sequence: Synthetic primer
gcttctggaaaaacgccagca

SEQ ID NO: 6429 - DNA, 21 bp, Artificial Sequence
  Description of Artificial Sequence: Synthetic primer
attccttgcgctccgtacgaa

SEQ ID NO: 6430 - DNA, 22 bp, Artificial Sequence
  Description of Artificial Sequence: Synthetic primer
ctttgcattgcaggcacggtta

SEQ ID NO: 6431 - DNA, 21 bp, Artificial Sequence
  Description of Artificial Sequence: Synthetic primer
ccgaggttaaatccacaggcg

SEQ ID NO: 6432 - DNA, 21 bp, Artificial Sequence
  Description of Artificial Sequence: Synthetic primer
gcgcatttccttgccctcaaa

SEQ ID NO: 6433 - DNA, 21 bp, Artificial Sequence
  Description of Artificial Sequence: Synthetic primer
gttcacaggtacgacagcagc

SEQ ID NO: 6434 - DNA, 21 bp, Artificial Sequence
  Description of Artificial Sequence: Synthetic primer
tacgttgccaccaaaagagcc

SEQ ID NO: 6435 - DNA, 20 bp, Artificial Sequence
  Description of Artificial Sequence: Synthetic primer
agcaggctactgtggtcagg

SEQ ID NO: 6436 - DNA, 21 bp, Artificial Sequence
  Description of Artificial Sequence: Synthetic primer
cgattgcatacagcaggtgcc

SEQ ID NO: 6437 - DNA, 20 bp, Artificial Sequence
  Description of Artificial Sequence: Synthetic primer
ggcaggttttgaaggacccc

SEQ ID NO: 6438 - DNA, 21 bp, Artificial Sequence
  Description of Artificial Sequence: Synthetic primer
acgagcaatgcagtgaagggt

SEQ ID NO: 6439 - DNA, 22 bp, Artificial Sequence
  Description of Artificial Sequence: Synthetic primer
tgagaacgaaacccgtcaagca

SEQ ID NO: 6440 - DNA, 20 bp, Artificial Sequence
  Description of Artificial Sequence: Synthetic primer
cacgtcgatcaaacggcgag

SEQ ID NO: 6441 - DNA, 21 bp, Artificial Sequence
  Description of Artificial Sequence: Synthetic primer
cgtcaagcatgcagaaaggct

SEQ ID NO: 6442 - DNA, 20 bp, Artificial Sequence
  Description of Artificial Sequence: Synthetic primer
cccctaatccgcaccgtgta

SEQ ID NO: 6443 - DNA, 21 bp, Artificial Sequence
  Description of Artificial Sequence: Synthetic primer
cctgttccttctcccgaatgc

SEQ ID NO: 6444 - DNA, 22 bp, Artificial Sequence
  Description of Artificial Sequence: Synthetic primer
ggtacaaagtgaaaagggccgg

SEQ ID NO: 6445 - DNA, 21 bp, Artificial Sequence
  Description of Artificial Sequence: Synthetic primer
gtgcaatcaagccttgcccat

SEQ ID NO: 6446 - DNA, 20 bp, Artificial Sequence
  Description of Artificial Sequence: Synthetic primer
gaagtgatggtccctgccac

SEQ ID NO: 6447 - DNA, 21 bp, Artificial Sequence
  Description of Artificial Sequence: Synthetic primer
ggctctaacacatggtgaggc

SEQ ID NO: 6448 - DNA, 24 bp, Artificial Sequence
  Description of Artificial Sequence: Synthetic primer
aatcatggtcctagttgtagcccc

SEQ ID NO: 6449 - DNA, 22 bp, Artificial Sequence
  Description of Artificial Sequence: Synthetic primer
actaggatgagggagccaatgg

SEQ ID NO: 6450 - DNA, 22 bp, Artificial Sequence
  Description of Artificial Sequence: Synthetic primer
ctatggagatgcctcccaccat

SEQ ID NO: 6451 - DNA, 21 bp, Artificial Sequence
  Description of Artificial Sequence: Synthetic primer
gaagagctcggcatcggagat

SEQ ID NO: 6452 - DNA, 21 bp, Artificial Sequence
  Description of Artificial Sequence: Synthetic primer
tcccaaaacgaactgtgtgcg

SEQ ID NO: 6453 - DNA, 21 bp, Artificial Sequence
  Description of Artificial Sequence: Synthetic primer
tggctagagcgaccttgttcg

SEQ ID NO: 6454 - DNA, 21 bp, Artificial Sequence
  Description of Artificial Sequence: Synthetic primer
tcgagatcaggcatccacacc

SEQ ID NO: 6455 - DNA, 25 bp, Artificial Sequence
  Description of Artificial Sequence: Synthetic primer
ccaaagtatttggtgggattctcgc

SEQ ID NO: 6456 - DNA, 21 bp, Artificial Sequence
  Description of Artificial Sequence: Synthetic primer
ctgcaacaagtgaaaagcgcc

SEQ ID NO: 6457 - DNA, 24 bp, Artificial Sequence
  Description of Artificial Sequence: Synthetic primer
ggattctcgctttttcccaccaag

SEQ ID NO: 6458 - DNA, 22 bp, Artificial Sequence
  Description of Artificial Sequence: Synthetic primer
tacatcgatccagctcgtgctg

SEQ ID NO: 6459 - DNA, 23 bp, Artificial Sequence
  Description of Artificial Sequence: Synthetic primer
cggaacactaaaacggggacatg

SEQ ID NO: 6460 - DNA, 24 bp, Artificial Sequence
  Description of Artificial Sequence: Synthetic primer
ccacgatcgacattgatctggcta

SEQ ID NO: 6461 - DNA, 23 bp, Artificial Sequence
  Description of Artificial Sequence: Synthetic primer
tcttcctggcaagcactaggaac

SEQ ID NO: 6462 - DNA, 24 bp, Artificial Sequence
  Description of Artificial Sequence: Synthetic primer
gtttcatcaagccttacggtcacc

SEQ ID NO: 6463 - DNA, 21 bp, Artificial Sequence
  Description of Artificial Sequence: Synthetic primer
accgagtaagggcttgttcgg

SEQ ID NO: 6464 - DNA, 22 bp, Artificial Sequence
  Description of Artificial Sequence: Synthetic primer
gctggcgatgagcgaaatgtag

SEQ ID NO: 6465 - DNA, 21 bp, Artificial Sequence
  Description of Artificial Sequence: Synthetic primer
tctccagcaacccctagatgc

SEQ ID NO: 6466 - DNA, 21 bp, Artificial Sequence
  Description of Artificial Sequence: Synthetic primer
cagcaacgtcggttcgagatg

SEQ ID NO: 6467 - DNA, 23 bp, Artificial Sequence
  Description of Artificial Sequence: Synthetic primer
gcagtgacactatagccacgtgt

SEQ ID NO: 6468 - DNA, 22 bp, Artificial Sequence
  Description of Artificial Sequence: Synthetic primer
gcccaatcaattgtccctggac

SEQ ID NO: 6469 - DNA, 22 bp, Artificial Sequence
  Description of Artificial Sequence: Synthetic primer
tgctacccaatggtgtggactt

SEQ ID NO: 6470 - DNA, 21 bp, Artificial Sequence
  Description of Artificial Sequence: Synthetic primer
aatgcccattcggttgaaccc

SEQ ID NO: 6471 - DNA, 21 bp, Artificial Sequence
  Description of Artificial Sequence: Synthetic primer
tctgatgatcgggttgaggcc

SEQ ID NO: 6472 - DNA, 22 bp, Artificial Sequence
  Description of Artificial Sequence: Synthetic primer
cctccggaatcatttcccgttg

SEQ ID NO: 6473 - DNA, 21 bp, Artificial Sequence
  Description of Artificial Sequence: Synthetic primer
gtgctgatctggttgtgggtc

SEQ ID NO: 6474 - DNA, 21 bp, Artificial Sequence
  Description of Artificial Sequence: Synthetic primer
cggaacaattcctgggcacaa

SEQ ID NO: 6475 - DNA, 23 bp, Artificial Sequence
  Description of Artificial Sequence: Synthetic primer
agctatggttaacgggaatgcca

SEQ ID NO: 6476 - DNA, 24 bp, Artificial Sequence
  Description of Artificial Sequence: Synthetic primer
ccacgatcgacattgatctggcta

SEQ ID NO: 6477 - DNA, 21 bp, Artificial Sequence
  Description of Artificial Sequence: Synthetic primer
tctagcgagaggtggtcaggt

SEQ ID NO: 6478 - DNA, 24 bp, Artificial Sequence
  Description of Artificial Sequence: Synthetic primer
gtttcatcaagccttacggtcacc

SEQ ID NO: 6479 - DNA, 22 bp, Artificial Sequence
  Description of Artificial Sequence: Synthetic primer
gctgaaattgctgcatcatggc

SEQ ID NO: 6480 - DNA, 20 bp, Artificial Sequence
  Description of Artificial Sequence: Synthetic primer
gttgccttggtaggtccagc

SEQ ID NO: 6481 - DNA, 21 bp, Artificial Sequence
  Description of Artificial Sequence: Synthetic primer
agctgctacatctgtggtcgg

SEQ ID NO: 6482 - DNA, 21 bp, Artificial Sequence
  Description of Artificial Sequence: Synthetic primer
cagcaacgtcggttcgagatg

SEQ ID NO: 6483 - DNA, 25 bp, Artificial Sequence
  Description of Artificial Sequence: Synthetic primer
ccttcacagtacttgaactgctgca

SEQ ID NO: 6484 - DNA, 20 bp, Artificial Sequence
  Description of Artificial Sequence: Synthetic primer
cactcacatggtgcgttccg

SEQ ID NO: 6485 - DNA, 21 bp, Artificial Sequence
  Description of Artificial Sequence: Synthetic primer
tgtatgcctcgtcatcgaggg

SEQ ID NO: 6486 - DNA, 20 bp, Artificial Sequence
  Description of Artificial Sequence: Synthetic primer
aggggaatgaccaggagcag

SEQ ID NO: 6487 - DNA, 23 bp, Artificial Sequence
  Description of Artificial Sequence: Synthetic primer
tcacgtactgaccacagaacacc

SEQ ID NO: 6488 - DNA, 22 bp, Artificial Sequence
  Description of Artificial Sequence: Synthetic primer
gaatatgctccacgcgcatctc

SEQ ID NO: 6489 - DNA, 23 bp, Artificial Sequence
  Description of Artificial Sequence: Synthetic primer
gctgactctaaaaccgccttgtg

SEQ ID NO: 6490 - DNA, 21 bp, Artificial Sequence
  Description of Artificial Sequence: Synthetic primer
gatccggcttgttcgcttgac

SEQ ID NO: 6491 - DNA, 20 bp, Artificial Sequence
  Description of Artificial Sequence: Synthetic primer
aaccatagtggctcgccagt

SEQ ID NO: 6492 - DNA, 22 bp, Artificial Sequence
  Description of Artificial Sequence: Synthetic primer
aatcgcactaggtcagcatggt

SEQ ID NO: 6493 - DNA, 24 bp, Artificial Sequence
  Description of Artificial Sequence: Synthetic primer
gatcatgtcgttagcctccaacca

SEQ ID NO: 6494 - DNA, 21 bp, Artificial Sequence
  Description of Artificial Sequence: Synthetic primer
gtgaagactcgagcttggcct

SEQ ID NO: 6495 - DNA, 21 bp, Artificial Sequence
  Description of Artificial Sequence: Synthetic primer
caacaagctggtttgcagggt

SEQ ID NO: 6496 - DNA, 24 bp, Artificial Sequence
  Description of Artificial Sequence: Synthetic primer
taacccccttagagatgcacatgc

SEQ ID NO: 6497 - DNA, 22 bp, Artificial Sequence
  Description of Artificial Sequence: Synthetic primer
accccagcaaattggacgatct

SEQ ID NO: 6498 - DNA, 25 bp, Artificial Sequence
  Description of Artificial Sequence: Synthetic primer
tagatcgatgaaaccggtcgatgtg

SEQ ID NO: 6499 - DNA, 21 bp, Artificial Sequence
  Description of Artificial Sequence: Synthetic primer
gaccaaccatttgttgcccct

SEQ ID NO: 6500 - DNA, 23 bp, Artificial Sequence
  Description of Artificial Sequence: Synthetic primer
cacgtctttgtagcgactgtcca

SEQ ID NO: 6501 - DNA, 21 bp, Artificial Sequence
  Description of Artificial Sequence: Synthetic primer
tccgaaaactcaagcatgccc

SEQ ID NO: 6502 - DNA, 23 bp, Artificial Sequence
  Description of Artificial Sequence: Synthetic primer
gtggtgaacttccctctagaccc

SEQ ID NO: 6503 - DNA, 24 bp, Artificial Sequence
  Description of Artificial Sequence: Synthetic primer
tggaaaaacgtagatgtgcttgcc

SEQ ID NO: 6504 - DNA, 24 bp, Artificial Sequence
  Description of Artificial Sequence: Synthetic primer
caagctctttgatcgtggttgacg

SEQ ID NO: 6505 - DNA, 24 bp, Artificial Sequence
  Description of Artificial Sequence: Synthetic primer
gcagtaaacctagtgatgctgcct

SEQ ID NO: 6506 - DNA, 20 bp, Artificial Sequence
  Description of Artificial Sequence: Synthetic primer
atgcttggtcaacgtgccac

SEQ ID NO: 6507 - DNA, 22 bp, Artificial Sequence
  Description of Artificial Sequence: Synthetic primer
cggtgaatgcaagctggatcac

SEQ ID NO: 6508 - DNA, 20 bp, Artificial Sequence
  Description of Artificial Sequence: Synthetic primer
gcacttgtgctatccgccag

SEQ ID NO: 6509 - DNA, 21 bp, Artificial Sequence
  Description of Artificial Sequence: Synthetic primer
cttttggtggcggagatcagg

SEQ ID NO: 6510 - DNA, 26 bp, Artificial Sequence
  Description of Artificial Sequence: Synthetic primer
tggaggaggaaatctctgctattcgt

SEQ ID NO: 6511 - DNA, 20 bp, Artificial Sequence
  Description of Artificial Sequence: Synthetic primer
acagtggactccctcgcaag

SEQ ID NO: 6512 - DNA, 22 bp, Artificial Sequence
  Description of Artificial Sequence: Synthetic primer
gtaagcttcctcgacacctcca

SEQ ID NO: 6513 - DNA, 22 bp, Artificial Sequence
  Description of Artificial Sequence: Synthetic primer
tctgaagcacagtttagccgca

SEQ ID NO: 6514 - DNA, 26 bp, Artificial Sequence
  Description of Artificial Sequence: Synthetic primer
gtggttatctgtagcttgagcactga

SEQ ID NO: 6515 - DNA, 22 bp, Artificial Sequence
  Description of Artificial Sequence: Synthetic primer
tgtgttccttctccatgcacct

SEQ ID NO: 6516 - DNA, 21 bp, Artificial Sequence
  Description of Artificial Sequence: Synthetic primer
ccttgtcacggagactctcgg

SEQ ID NO: 6517 - DNA, 21 bp, Artificial Sequence
  Description of Artificial Sequence: Synthetic primer
tcacatgcctcaactggagca

SEQ ID NO: 6518 - DNA, 20 bp, Artificial Sequence
  Description of Artificial Sequence: Synthetic primer
tggaagggcaaaactgagcc

SEQ ID NO: 6519 - DNA, 25 bp, Artificial Sequence
  Description of Artificial Sequence: Synthetic primer
gcgaccttttcattgttggagtagg

SEQ ID NO: 6520 - DNA, 20 bp, Artificial Sequence
  Description of Artificial Sequence: Synthetic primer
taccacaccatcgagccgtc

SEQ ID NO: 6521 - DNA, 23 bp, Artificial Sequence
  Description of Artificial Sequence: Synthetic primer
acgattcagtaggtagggtgcct

SEQ ID NO: 6522 - DNA, 20 bp, Artificial Sequence
  Description of Artificial Sequence: Synthetic primer
acccatttcgagctgcctgt

SEQ ID NO: 6523 - DNA, 21 bp, Artificial Sequence
  Description of Artificial Sequence: Synthetic primer
ccatgcagatgtcgaggcaac

SEQ ID NO: 6524 - DNA, 21 bp, Artificial Sequence
  Description of Artificial Sequence: Synthetic primer
tactgccttctgaaccgtcgg

SEQ ID NO: 6525 - DNA, 23 bp, Artificial Sequence
  Description of Artificial Sequence: Synthetic primer
tgtttagctacatccacgggcat

SEQ ID NO: 6526 - DNA, 22 bp, Artificial Sequence
  Description of Artificial Sequence: Synthetic primer
actgcaatgacaaggcacatcc

SEQ ID NO: 6527 - DNA, 22 bp, Artificial Sequence
  Description of Artificial Sequence: Synthetic primer
gcacgtcgttagtgatcgagct

SEQ ID NO: 6528 - DNA, 25 bp, Artificial Sequence
  Description of Artificial Sequence: Synthetic primer
gttgtcaacgaagcccgtctaattg

SEQ ID NO: 6529 - DNA, 21 bp, Artificial Sequence
  Description of Artificial Sequence: Synthetic primer
cctgcagttaacgcagacgtg

SEQ ID NO: 6530 - DNA, 26 bp, Artificial Sequence
  Description of Artificial Sequence: Synthetic primer
ctagaccgtactattgtgctgtgaag

SEQ ID NO: 6531 - DNA, 21 bp, Artificial Sequence
  Description of Artificial Sequence: Synthetic primer
tccttactggcccctagtcca

SEQ ID NO: 6532 - DNA, 21 bp, Artificial Sequence
  Description of Artificial Sequence: Synthetic primer
ctcccacgagcgactagctac

SEQ ID NO: 6533 - DNA, 22 bp, Artificial Sequence
  Description of Artificial Sequence: Synthetic primer
tgcaactatggacttggccaca

SEQ ID NO: 6534 - DNA, 22 bp, Artificial Sequence
  Description of Artificial Sequence: Synthetic primer
cctcacgaataaaagcaccccc

SEQ ID NO: 6535 - DNA, 22 bp, Artificial Sequence
  Description of Artificial Sequence: Synthetic primer
agtctacgtggcatacaacccc

SEQ ID NO: 6536 - DNA, 22 bp, Artificial Sequence
  Description of Artificial Sequence: Synthetic primer
gaaacttggaccttgctgtcgg

SEQ ID NO: 6537 - DNA, 24 bp, Artificial Sequence
  Description of Artificial Sequence: Synthetic primer
aggtctcgaacaaactccctatgc

SEQ ID NO: 6538 - DNA, 23 bp, Artificial Sequence
  Description of Artificial Sequence: Synthetic primer
ccattccatgaagaccgactcca

SEQ ID NO: 6539 - DNA, 23 bp, Artificial Sequence
  Description of Artificial Sequence: Synthetic primer
accaaatccgtttgctttcaccg

SEQ ID NO: 6540 - DNA, 23 bp, Artificial Sequence
  Description of Artificial Sequence: Synthetic primer
ctctgacagataccacgttcgct

SEQ ID NO: 6541 - DNA, 20 bp, Artificial Sequence
  Description of Artificial Sequence: Synthetic primer
caccgtttcacgaagctgca

SEQ ID NO: 6542 - DNA, 21 bp, Artificial Sequence
  Description of Artificial Sequence: Synthetic primer
accgaaatctgcgcgctagtt

SEQ ID NO: 6543 - DNA, 23 bp, Artificial Sequence
  Description of Artificial Sequence: Synthetic primer
acagaagaggttgcggagtaacg

SEQ ID NO: 6544 - DNA, 24 bp, Artificial Sequence
  Description of Artificial Sequence: Synthetic primer
aaacaaaatcgtatcgccgagcag

SEQ ID NO: 6545 - DNA, 21 bp, Artificial Sequence
  Description of Artificial Sequence: Synthetic primer
tacttggaccggcctctacct

SEQ ID NO: 6546 - DNA, 21 bp, Artificial Sequence
  Description of Artificial Sequence: Synthetic primer
aaccttgcaacagccccaaat

SEQ ID NO: 6547 - DNA, 21 bp, Artificial Sequence
  Description of Artificial Sequence: Synthetic primer
aggtaataccagtgagccgac

SEQ ID NO: 6548 - DNA, 24 bp, Artificial Sequence
  Description of Artificial Sequence: Synthetic primer
ccacgatcgacattgatctggcta

SEQ ID NO: 6549 - DNA, 20 bp, Artificial Sequence
  Description of Artificial Sequence: Synthetic primer
cactctgtactgggagaggg

SEQ ID NO: 6550 - DNA, 24 bp, Artificial Sequence
  Description of Artificial Sequence: Synthetic primer
gtttcatcaagccttacggtcacc

SEQ ID NO: 6551 - DNA, 20 bp, Artificial Sequence
  Description of Artificial Sequence: Synthetic primer
ataatgcagcgcttgcagat

SEQ ID NO: 6552 - DNA, 22 bp, Artificial Sequence
  Description of Artificial Sequence: Synthetic primer
gctggcgatgagcgaaatgtag

SEQ ID NO: 6553 - DNA, 23 bp, Artificial Sequence
  Description of Artificial Sequence: Synthetic primer
ctcaattccatgtgcaaccaaac

SEQ ID NO: 6554 - DNA, 21 bp, Artificial Sequence
  Description of Artificial Sequence: Synthetic primer
cagcaacgtcggttcgagatg

SEQ ID NO: 6555 - DNA, 22 bp, Artificial Sequence
  Description of Artificial Sequence: Synthetic primer
gtggtgataccgtcgtctctcc

SEQ ID NO: 6556 - DNA, 21 bp, Artificial Sequence
  Description of Artificial Sequence: Synthetic primer
cactttgtccctgctcggttc

SEQ ID NO: 6557 - DNA, 24 bp, Artificial Sequence
  Description of Artificial Sequence: Synthetic primer
gaaacaagccattgattgtgccca

SEQ ID NO: 6558 - DNA, 20 bp, Artificial Sequence
  Description of Artificial Sequence: Synthetic primer
gtcgactcacaacgcttccc

SEQ ID NO: 6559 - DNA, 22 bp, Artificial Sequence
  Description of Artificial Sequence: Synthetic primer
agtacaacactgagacgtgggc

SEQ ID NO: 6560 - DNA, 24 bp, Artificial Sequence
  Description of Artificial Sequence: Synthetic primer
actaggattgctagggagcacgaa

SEQ ID NO: 6561 - DNA, 21 bp, Artificial Sequence
  Description of Artificial Sequence: Synthetic primer
agattgcagggcacttgaggt

SEQ ID NO: 6562 - DNA, 23 bp, Artificial Sequence
  Description of Artificial Sequence: Synthetic primer
acaggattacaagcccaaaccca

SEQ ID NO: 6563 - DNA, 21 bp, Artificial Sequence
  Description of Artificial Sequence: Synthetic primer
ttcttcaggcggcatcgcata

SEQ ID NO: 6564 - DNA, 24 bp, Artificial Sequence
  Description of Artificial Sequence: Synthetic primer
ccacgatcgacattgatctggcta

SEQ ID NO: 6565 - DNA, 21 bp, Artificial Sequence
  Description of Artificial Sequence: Synthetic primer
tagtagccgacaatgtggccc

SEQ ID NO: 6566 - DNA, 24 bp, Artificial Sequence
  Description of Artificial Sequence: Synthetic primer
gtttcatcaagccttacggtcacc

SEQ ID NO: 6567 - DNA, 22 bp, Artificial Sequence
  Description of Artificial Sequence: Synthetic primer
cgctcaggaaatccttgatgcc

SEQ ID NO: 6568 - DNA, 22 bp, Artificial Sequence
  Description of Artificial Sequence: Synthetic primer
gctggcgatgagcgaaatgtag

SEQ ID NO: 6569 - DNA, 20 bp, Artificial Sequence
  Description of Artificial Sequence: Synthetic primer
gtgaacgacggcaacaagct

SEQ ID NO: 6570 - DNA, 21 bp, Artificial Sequence
  Description of Artificial Sequence: Synthetic primer
cagcaacgtcggttcgagatg

SEQ ID NO: 6571 - DNA, 21 bp, Artificial Sequence
  Description of Artificial Sequence: Synthetic primer
gaggtcccttacgggtcatcg

SEQ ID NO: 6572 - DNA, 22 bp, Artificial Sequence
  Description of Artificial Sequence: Synthetic primer
accaggtctatcttgcgcagac

SEQ ID NO: 6573 - DNA, 21 bp, Artificial Sequence
  Description of Artificial Sequence: Synthetic primer
aatagcgtggtcgggtcctag

SEQ ID NO: 6574 - DNA, 21 bp, Artificial Sequence
  Description of Artificial Sequence: Synthetic primer
acgaacgatccaaggtgcagt

SEQ ID NO: 6575 - DNA, 21 bp, Artificial Sequence
  Description of Artificial Sequence: Synthetic primer
ccaatggacgacagcggttag

SEQ ID NO: 6576 - DNA, 22 bp, Artificial Sequence
  Description of Artificial Sequence: Synthetic primer
acgagaacaagccactcttgct

SEQ ID NO: 6577 - DNA, 21 bp, Artificial Sequence
  Description of Artificial Sequence: Synthetic primer
caaccggagaacggatagcct

SEQ ID NO: 6578 - DNA, 22 bp, Artificial Sequence
  Description of Artificial Sequence: Synthetic primer
tgaagatttccctaccgtcgcc

SEQ ID NO: 6579 - DNA, 20 bp, Artificial Sequence
  Description of Artificial Sequence: Synthetic primer
agtactggggacgttcaccg

SEQ ID NO: 6580 - DNA, 21 bp, Artificial Sequence
  Description of Artificial Sequence: Synthetic primer
cgacaagaacccggtacatgc

SEQ ID NO: 6581 - DNA, 21 bp, Artificial Sequence
  Description of Artificial Sequence: Synthetic primer
agagctgaaactgatcgcggt

SEQ ID NO: 6582 - DNA, 20 bp, Artificial Sequence
  Description of Artificial Sequence: Synthetic primer
gacagagtccgatccctgct

SEQ ID NO: 6583 - DNA, 22 bp, Artificial Sequence
  Description of Artificial Sequence: Synthetic primer
gccacacggattttgcgtatca

SEQ ID NO: 6584 - DNA, 21 bp, Artificial Sequence
  Description of Artificial Sequence: Synthetic primer
cttttgtcggtcctgccactg

SEQ ID NO: 6585 - DNA, 20 bp, Artificial Sequence
  Description of Artificial Sequence: Synthetic primer
agcaacgtagggtcacggac

SEQ ID NO: 6586 - DNA, 21 bp, Artificial Sequence
  Description of Artificial Sequence: Synthetic primer
gaggagtcttcgatgccacga

SEQ ID NO: 6587 - DNA, 23 bp, Artificial Sequence
  Description of Artificial Sequence: Synthetic primer
gaaagcaccaggtcgtatcttgc

SEQ ID NO: 6588 - DNA, 23 bp, Artificial Sequence
  Description of Artificial Sequence: Synthetic primer
cgcacaatcttcgcttcaaacca

SEQ ID NO: 6589 - DNA, 23 bp, Artificial Sequence
  Description of Artificial Sequence: Synthetic primer
gcattgctcttcaggaggtacgt

SEQ ID NO: 6590 - DNA, 20 bp, Artificial Sequence
  Description of Artificial Sequence: Synthetic primer
cagctgtgcaagtccgactg

SEQ ID NO: 6591 - DNA, 21 bp, Artificial Sequence
  Description of Artificial Sequence: Synthetic primer
tctccatacctgcactgggtg

SEQ ID NO: 6592 - DNA, 21 bp, Artificial Sequence
  Description of Artificial Sequence: Synthetic primer
acgtgctctcagcaacatcca

SEQ ID NO: 6593 - DNA, 21 bp, Artificial Sequence
  Description of Artificial Sequence: Synthetic primer
cgtccaaacaggctagacagc

SEQ ID NO: 6594 - DNA, 20 bp, Artificial Sequence
  Description of Artificial Sequence: Synthetic primer
tgccttttgcgtcaacggtg

SEQ ID NO: 6595 - DNA, 20 bp, Artificial Sequence
  Description of Artificial Sequence: Synthetic primer
ccatccagatcgcggttgtc

SEQ ID NO: 6596 - DNA, 21 bp, Artificial Sequence
  Description of Artificial Sequence: Synthetic primer
tacgagttcacgccattgcgt

SEQ ID NO: 6597 - DNA, 21 bp, Artificial Sequence
  Description of Artificial Sequence: Synthetic primer
gtctcctctttgacggttgcg

SEQ ID NO: 6598 - DNA, 20 bp, Artificial Sequence
  Description of Artificial Sequence: Synthetic primer
tcgatccacactcgcatgca

SEQ ID NO: 6599 - DNA, 20 bp, Artificial Sequence
  Description of Artificial Sequence: Synthetic primer
gtggaccagtgtaaagcccg

SEQ ID NO: 6600 - DNA, 20 bp, Artificial Sequence
  Description of Artificial Sequence: Synthetic primer
tccctagtgccaggacctga

SEQ ID NO: 6601 - DNA, 21 bp, Artificial Sequence
  Description of Artificial Sequence: Synthetic primer
acaccaaatgtccggtagcga

SEQ ID NO: 6602 - DNA, 20 bp, Artificial Sequence
  Description of Artificial Sequence: Synthetic primer
cgacgattctccattggccg

SEQ ID NO: 6603 - DNA, 22 bp, Artificial Sequence
  Description of Artificial Sequence: Synthetic primer
gctagaaacgctgaacagcagc

SEQ ID NO: 6604 - DNA, 22 bp, Artificial Sequence
  Description of Artificial Sequence: Synthetic primer
cgggtttagaatccacaagccg

SEQ ID NO: 6605 - DNA, 22 bp, Artificial Sequence
  Description of Artificial Sequence: Synthetic primer
gacaaaagctgccatcaacgct

SEQ ID NO: 6606 - DNA, 21 bp, Artificial Sequence
  Description of Artificial Sequence: Synthetic primer
cccgatatggacaggtcagct

SEQ ID NO: 6607 - DNA, 21 bp, Artificial Sequence
  Description of Artificial Sequence: Synthetic primer
aaaggcgacacacacctttgc

SEQ ID NO: 6608 - DNA, 20 bp, Artificial Sequence
  Description of Artificial Sequence: Synthetic primer
agacagccatcctcactcgc

SEQ ID NO: 6609 - DNA, 20 bp, Artificial Sequence
  Description of Artificial Sequence: Synthetic primer
tttggtgcagaggccgagaa

SEQ ID NO: 6610 - DNA, 21 bp, Artificial Sequence
  Description of Artificial Sequence: Synthetic primer
aagtagccaggcagacaacca

SEQ ID NO: 6611 - DNA, 21 bp, Artificial Sequence
  Description of Artificial Sequence: Synthetic primer
ctaggcagggtggcatgaaag

SEQ ID NO: 6612 - DNA, 24 bp, Artificial Sequence
  Description of Artificial Sequence: Synthetic primer
ccacgatcgacattgatctggcta

SEQ ID NO: 6613 - DNA, 22 bp, Artificial Sequence
  Description of Artificial Sequence: Synthetic primer
accatcagaggttgtgaaggca

SEQ ID NO: 6614 - DNA, 22 bp, Artificial Sequence
  Description of Artificial Sequence: Synthetic primer
caaattcccactaagcgctcgg

SEQ ID NO: 6615 - DNA, 23 bp, Artificial Sequence
  Description of Artificial Sequence: Synthetic primer
aagggcaacttcatggttcaacc

SEQ ID NO: 6616 - DNA, 20 bp, Artificial Sequence
  Description of Artificial Sequence: Synthetic primer
gttgccttggtaggtccagc

SEQ ID NO: 6617 - DNA, 24 bp, Artificial Sequence
  Description of Artificial Sequence: Synthetic primer
accagtaaatccacaacccatggt

SEQ ID NO: 6618 - DNA, 21 bp, Artificial Sequence
  Description of Artificial Sequence: Synthetic primer
gtaaaggtgagcagaggcacg

SEQ ID NO: 6619 - DNA, 21 bp, Artificial Sequence
  Description of Artificial Sequence: Synthetic primer
gattgctacgcagaccgccta

SEQ ID NO: 6620 - protein, 7 aa, Artificial Sequence
  Description of Artificial Sequence: Synthetic peptide
DRSALAR

SEQ ID NO: 6621 - protein, 7 aa, Artificial Sequence
  Description of Artificial Sequence: Synthetic peptide
DYYGRHG

SEQ ID NO: 6622 - protein, 7 aa, Artificial Sequence
  Description of Artificial Sequence: Synthetic peptide
DRSHLAR

SEQ ID NO: 6623 - protein, 7 aa, Artificial Sequence
  Description of Artificial Sequence: Synthetic peptide
YRSSLKE

SEQ ID NO: 6624 - protein, 7 aa, Artificial Sequence
  Description of Artificial Sequence: Synthetic peptide
TSGNLTR

SEQ ID NO: 6625 - protein, 7 aa, Artificial Sequence
  Description of Artificial Sequence: Synthetic peptide
HHHVLVQ

SEQ ID NO: 6626 - protein, 7 aa, Artificial Sequence
  Description of Artificial Sequence: Synthetic peptide
QNATRTK

SEQ ID NO: 6627 - protein, 7 aa, Artificial Sequence
  Description of Artificial Sequence: Synthetic peptide
DRSTRTK

SEQ ID NO: 6628 - protein, 7 aa, Artificial Sequence
  Description of Artificial Sequence: Synthetic peptide
RRDNLHS

SEQ ID NO: 6629 - protein, 7 aa, Artificial Sequence
  Description of Artificial Sequence: Synthetic peptide
RRDNLHS

SEQ ID NO: 6630 - protein, 7 aa, Artificial Sequence
  Description of Artificial Sequence: Synthetic peptide
HRSSLRR

SEQ ID NO: 6631 - protein, 7 aa, Artificial Sequence
  Description of Artificial Sequence: Synthetic peptide
QSSDLSR

SEQ ID NO: 6632 - protein, 7 aa, Artificial Sequence
  Description of Artificial Sequence: Synthetic peptide
QWSTRKR

SEQ ID NO: 6633 - protein, 7 aa, Artificial Sequence
  Description of Artificial Sequence: Synthetic peptide
RSDVLSE

SEQ ID NO: 6634 - protein, 7 aa, Artificial Sequence
  Description of Artificial Sequence: Synthetic peptide
QTVHRNS

SEQ ID NO: 6635 - protein, 7 aa, Artificial Sequence
  Description of Artificial Sequence: Synthetic peptide
RSDTLSE

SEQ ID NO: 6636 - protein, 7 aa, Artificial Sequence
  Description of Artificial Sequence: Synthetic peptide
FRGSLTW

SEQ ID NO: 6637 - protein, 7 aa, Artificial Sequence
  Description of Artificial Sequence: Synthetic peptide
RSDNLST

SEQ ID NO: 6638 - protein, 7 aa, Artificial Sequence
  Description of Artificial Sequence: Synthetic peptide
RSTHRTQ

SEQ ID NO: 6639 - protein, 7 aa, Artificial Sequence
  Description of Artificial Sequence: Synthetic peptide
RSDNLSV

SEQ ID NO: 6640 - protein, 7 aa, Artificial Sequence
  Description of Artificial Sequence: Synthetic peptide
QKATRIN

SEQ ID NO: 6641 - protein, 7 aa, Artificial Sequence
  Description of Artificial Sequence: Synthetic peptide
DRSNLTR

SEQ ID NO: 6642 - protein, 7 aa, Artificial Sequence
  Description of Artificial Sequence: Synthetic peptide
QSGNLAR

SEQ ID NO: 6643 - protein, 7 aa, Artificial Sequence
  Description of Artificial Sequence: Synthetic peptide
CRQNLAN

SEQ ID NO: 6644 - protein, 7 aa, Artificial Sequence
  Description of Artificial Sequence: Synthetic peptide
DRSNLSR

SEQ ID NO: 6645 - protein, 7 aa, Artificial Sequence
  Description of Artificial Sequence: Synthetic peptide
DGRNLRH

SEQ ID NO: 6646 - protein, 7 aa, Artificial Sequence
  Description of Artificial Sequence: Synthetic peptide
RSDHLST

SEQ ID NO: 6647 - protein, 7 aa, Artificial Sequence
  Description of Artificial Sequence: Synthetic peptide
RSDNLTR

SEQ ID NO: 6648 - protein, 7 aa, Artificial Sequence
  Description of Artificial Sequence: Synthetic peptide
DRSNRTT

SEQ ID NO: 6649 - protein, 7 aa, Artificial Sequence
  Description of Artificial Sequence: Synthetic peptide
QNATRIN

SEQ ID NO: 6650 - protein, 7 aa, Artificial Sequence
  Description of Artificial Sequence: Synthetic peptide
QSGNLAR

SEQ ID NO: 6651 - protein, 7 aa, Artificial Sequence
  Description of Artificial Sequence: Synthetic peptide
HKLSLSI

SEQ ID NO: 6652 - protein, 7 aa, Artificial Sequence
  Description of Artificial Sequence: Synthetic peptide
DRSDLSR

SEQ ID NO: 6653 - protein, 7 aa, Artificial Sequence
  Description of Artificial Sequence: Synthetic peptide
YRSNLVR

SEQ ID NO: 6654 - protein, 7 aa, Artificial Sequence
  Description of Artificial Sequence: Synthetic peptide
DRSALSR

SEQ ID NO: 6655 - protein, 7 aa, Artificial Sequence
  Description of Artificial Sequence: Synthetic peptide
QSGSLTR

SEQ ID NO: 6656 - protein, 7 aa, Artificial Sequence
  Description of Artificial Sequence: Synthetic peptide
RSDNLTR

SEQ ID NO: 6657 - protein, 7 aa, Artificial Sequence
  Description of Artificial Sequence: Synthetic peptide
RQDCLSL

SEQ ID NO: 6658 - protein, 7 aa, Artificial Sequence
  Description of Artificial Sequence: Synthetic peptide
RNDNRKT

SEQ ID NO: 6659 - protein, 7 aa, Artificial Sequence
  Description of Artificial Sequence: Synthetic peptide
QSGNLAR

SEQ ID NO: 6660 - protein, 7 aa, Artificial Sequence
  Description of Artificial Sequence: Synthetic peptide
DQSGLAH

SEQ ID NO: 6661 - protein, 7 aa, Artificial Sequence
  Description of Artificial Sequence: Synthetic peptide
QSANRTK

SEQ ID NO: 6662 - protein, 7 aa, Artificial Sequence
  Description of Artificial Sequence: Synthetic peptide
DRSDLSR

SEQ ID NO: 6663 - protein, 7 aa, Artificial Sequence
  Description of Artificial Sequence: Synthetic peptide
RSHHLKA

SEQ ID NO: 6664 - protein, 7 aa, Artificial Sequence
  Description of Artificial Sequence: Synthetic peptide
QSGNLAR

SEQ ID NO: 6665 - protein, 7 aa, Artificial Sequence
  Description of Artificial Sequence: Synthetic peptide
QSGSLTR

SEQ ID NO: 6666 - protein, 7 aa, Artificial Sequence
  Description of Artificial Sequence: Synthetic peptide
DRSALSR

SEQ ID NO: 6667 - protein, 7 aa, Artificial Sequence
  Description of Artificial Sequence: Synthetic peptide
QSGSLTR

SEQ ID NO: 6668 - protein, 7 aa, Artificial Sequence
  Description of Artificial Sequence: Synthetic peptide
QSGNLAR

SEQ ID NO: 6669 - protein, 7 aa, Artificial Sequence
  Description of Artificial Sequence: Synthetic peptide
QSGNLAR

SEQ ID NO: 6670 - protein, 7 aa, Artificial Sequence
  Description of Artificial Sequence: Synthetic peptide
WRISLAA

SEQ ID NO: 6671 - protein, 7 aa, Artificial Sequence
  Description of Artificial Sequence: Synthetic peptide
RSDNLSE

SEQ ID NO: 6672 - protein, 7 aa, Artificial Sequence
  Description of Artificial Sequence: Synthetic peptide
RSQHRKT

SEQ ID NO: 6673 - protein, 7 aa, Artificial Sequence
  Description of Artificial Sequence: Synthetic peptide
QSSDLSR

SEQ ID NO: 6674 - protein, 7 aa, Artificial Sequence
  Description of Artificial Sequence: Synthetic peptide
RSANLAR

SEQ ID NO: 6675 - protein, 7 aa, Artificial Sequence
  Description of Artificial Sequence: Synthetic peptide
RSDHLTT

SEQ ID NO: 6676 - protein, 7 aa, Artificial Sequence
  Description of Artificial Sequence: Synthetic peptide
RSDNLSE

SEQ ID NO: 6677 - protein, 7 aa, Artificial Sequence
  Description of Artificial Sequence: Synthetic peptide
DRSHLAR

SEQ ID NO: 6678 - protein, 7 aa, Artificial Sequence
  Description of Artificial Sequence: Synthetic peptide
QSAHRKN

SEQ ID NO: 6679 - protein, 7 aa, Artificial Sequence
  Description of Artificial Sequence: Synthetic peptide
LKHHLTD

SEQ ID NO: 6680 - protein, 7 aa, Artificial Sequence
  Description of Artificial Sequence: Synthetic peptide
TSGNLTR

SEQ ID NO: 6681 - protein, 7 aa, Artificial Sequence
  Description of Artificial Sequence: Synthetic peptide
DRSNLTR

SEQ ID NO: 6682 - protein, 7 aa, Artificial Sequence
  Description of Artificial Sequence: Synthetic peptide
RSDNLSQ

SEQ ID NO: 6683 - protein, 7 aa, Artificial Sequence
  Description of Artificial Sequence: Synthetic peptide
RKADRTK

SEQ ID NO: 6684 - protein, 7 aa, Artificial Sequence
  Description of Artificial Sequence: Synthetic peptide
TSGNLTR

SEQ ID NO: 6685 - protein, 7 aa, Artificial Sequence
  Description of Artificial Sequence: Synthetic peptide
DSSNLAT

SEQ ID NO: 6686 - DNA, 44 bp, Artificial Sequence
  Description of Artificial Sequence: Synthetic primer
  misc_feature (22)..(24): n is a, c, g, or t
ttcatggttgttaccactcatnnnatgatccctttgaagtaaac

SEQ ID NO: 6687 - DNA, 36 bp, Artificial Sequence
  Description of Artificial Sequence: Synthetic primer
  misc_feature (18)..(19): n is a, c, g, or t
ttctacgattacttctannctgctagtcagattgaa

SEQ ID NO: 6688 - DNA, 40 bp, Artificial Sequence
  Description of Artificial Sequence: Synthetic primer
  misc_feature (22)..(23): n is a, c, g, or t
tgatgcaaggtggcgtaaaggnngggacataaagaggcag

SEQ ID NO: 6689 - DNA, 37 bp, Artificial Sequence
  Description of Artificial Sequence: Synthetic primer
  misc_feature (18)..(19): n is a, c, g, or t
gattacctccaccttttnnctaggccctaatatcgaa

SEQ ID NO: 6690 - DNA, 43 bp, Artificial Sequence
  Description of Artificial Sequence: Synthetic primer
  misc_feature (21)..(22): n is a, c, g, or t
atccctctatccttcacgaanngaaacgatctcgaaggacgat

SEQ ID NO: 6691 - DNA, 24 bp, Artificial Sequence
  Description of Artificial Sequence: Synthetic primer
tatatggtggccaatggacgatgg

SEQ ID NO: 6692 - DNA, 20 bp, Artificial Sequence
  Description of Artificial Sequence: Synthetic primer
ccacaggagcaagcagtgac

SEQ ID NO: 6693 - DNA, 20 bp, Artificial Sequence
  Description of Artificial Sequence: Synthetic primer
cgcatctttgggggtagtgg

SEQ ID NO: 6694 - DNA, 20 bp, Artificial Sequence
  Description of Artificial Sequence: Synthetic primer
agtacccagttggtctcgcc
